United States Patent 7,745,391 (HUMAN THROMBOSPONDIN POLYPEPTIDE) - sequence listing, part 133

SEQ ID NO: 362209 - DNA, 3920 bp, Homo sapiens
  misc_feature (3781)..(3781): n is a, c, g, or t
  misc_feature (3787)..(3787): n is a, c, g, or t
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgacaaaaaaaaaaaaaaatnaaaaanaaaaaaacatacatccttcactctatcctttttactcctatctccctcctcacccttctcattctcatccttatcaaaatcctccgcccccattttaccttcctttgctcatattcctctatagggtggccct

SEQ ID NO: 362210 - DNA, 3638 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362211 - DNA, 3392 bp, Homo sapiens
tcgcttgttggtcgtctctcaggatcccattttatctgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362212 - DNA, 3661 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362213 - DNA, 3362 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaacattacgttcatgagcctgtgcagacattataaggtct

SEQ ID NO: 362214 - DNA, 2881 bp, Homo sapiens
aagatagagtgtttaataaatataagattcagatatactaccatctctcatcataatatggaaagcattaaagttgactaccgataatgggatcttcacattctctatcatggattaaatcagcccatagttcctctatatacttacgaccaaacccttgttaatcccttacttctggaatccatataggtgttttaggggggttttgggaggggttgtttttttttttaagaaacagggtctcattctgtcgcccaggctggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362215 - DNA, 2993 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgcccatttccctgtggaatctagtatcagtgttgtatttagcaaattcattt

SEQ ID NO: 362216 - DNA, 2188 bp, Homo sapiens
  misc_feature (35)..(35): n is a, c, g, or t
  misc_feature (41)..(41): n is a, c, g, or t
tatagaactcgagctggtaccctctctccacaccnctctcntaactggatgacttctggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362217 - DNA, 2808 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaattgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362218 - DNA, 1766 bp, Homo sapiens
ccgcgaatgtcaaaccggtctgctcaggtatggacccaagtccggggacgaagtgtagcgccgagggccacacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaacatctgcagcaaggtcaaggccgaggtgcagaatctcggcggggagcttgttgtctctggggtggacagcgccatgtccctgatccaggcagccaagaacttgatgaatgctgtggtgcagacagtgaaggcatcctacgtcgcctctaccaaataccaaaagtcacagggtatggcttccctcaaccttcctgctgtgtcatggaagatgaaggcaccagagaaaaagccattggtgaagagagagaaacaggatgagacacagaccaagattaaacgggcatctcagaagaagcacgtgaacccggtgcaggccctcagcgagttcaaagctatggacagcatctaagtctgcccaggccggccgcccccacccctcggggctcctgaatatcagtcactgttcgtcactcaaatgaatttgctaaatacaacactgatactagattccacagggaaatgggcagactgaaccagtccaggtggtgaattttccaagaacatagtttaagttgattaaaaatgcttttagaatgcaggagcctacttctagctgtattttttgtatgcttaaataaaaataaaaattcataaccaaagagaatcccacattagcttgttagtaatgctctgaccaagccgagatgcccattctcttagtgatggcggcgttagggtttgagagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362219 - DNA, 2670 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaaaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccgactcggcttgcaagcaggacctgctggcctacctgcaacgcatcgccctctactgccaccagctgaaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362220 - DNA, 2398 bp, Homo sapiens
cggcccatttcctcctcctagccggactggagggagacaaagcagcgcccgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgactttgagacagaagattttgatgtcagaagcaggacgagcgtccagacagaagacgatcagctgatagctggccagagtgcccgggcgatcatggctcagcttccccaggagcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362221 - DNA, 3683 bp, Homo sapiens
  misc_feature (19)..(19): n is a, c, g, or t
  misc_feature (22)..(22): n is a, c, g, or t
  misc_feature (2071)..(2071): n is a, c, g, or t
  misc_feature (2082)..(2082): n is a, c, g, or t
  misc_feature (2118)..(2118): n is a, c, g, or t
  misc_feature (2477)..(2477): n is a, c, g, or t
  misc_feature (2590)..(2590): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttattaatgctgcactggctttagcagcaaaaccacagagtaaactggcccaagagaacatggatctttttaaagaacaatgggaaaaacaagtccgtgttctcacagatgctgtcgatgacattacttccattgatgacttcttggctgtctcagagaatcacattttggaagatgtgaacaaatgtgtcattgctctccaagagaaggatgtggatggcctggaccgcacagctggtgcaattcgaggccgggcagcccgggtcattcacgtagtcacctcagagatggacaactatgagccaggagtctacacagagaaggttctggaagccactaagctgctctccaacacagtcatgccacgttttactgagcaagtagaagcagccgtggaagccctcagctcggaccctgcccagcccatggatgagaatgagtttatcgatgcttcccgcctggtatatgatggcatccgggacatcaggaaagcagtgctgatgataaggacccctgaggagttggatgactctgaatctaagagaacacgaacgactctgtgtggagtgatcacggaacgcgagtgcatgagncgatcctcgcnagccagtgagagactgatgcaggcttgaatagacantggcctacgtagtctgcccgggacgtactcagtgggcgtcatccttcctccaggtagacacaacacaagcgaagattgcggaacaggtggccagcttccaggaagaaaagagcaagctggatgctgaagtgtccaaatgggacgacagtggcaatgacatcattgtgctggccaagcagatgtgcatgattatgatggagatgacagactttacccgaggtaaaggaccactcaaaaatacatcggatgtcatcagtgctgccaagaaaattgctgaggcaggatccaggatggacaagcttggccgcaccattgcagaccattgccccttgcagaccattgccccgatcggcttgcangcaggacctgctggcctacctgcaacgcatcgccctctactgccaccagctgaacatctgcagcaaggtcaaggccgaggtgcagaatctcggcgcgggagcttgtgtctctnggggtggacagcgccatgtcctgatccacggcagccaagcaacgttgatgacatgctgctggctgcagacagctgcaacggcactccatacgctcgcctcctaccaaactaccacaacagctcacacgggctactggccttccgctcacacctctccctgccatgcagctcactgcgacacgactcgcaacggcaaccaagcacgcacacacaacgccccactctggctgcacagcacgcagcacgcaaaccacgcgactggaagaccaacagaaacccacacgcacttacacaccgggcgccagtcctacaagcccacgcacagccacacgctggacacccccagggctcgccccagcggccccctccacccacgaacgctctcacaccacgccctcactcggcggaccatgccccactacttcacacgactccctgtcccccccacggagacctccggtgcccgcaagacacggcacaccgagacgcactgacttatcgcgcgtgaccatcccacttgcaacagctaaattcaagcgtatcgaccttggcatctcatgactcccagcctttccaaaatttgaaaaattattggccattagacattatccaacaccagcattgcaatctacccgttaggaagctttatccgcagtcgatcaggggggtaacaacacctggcgtgcccactggcacctacttggctaacacctccacgccctccgccacagcgccatggccgcatgcaacaagcttttctatccgcacatacggaaaaaccactgtaaccgcgtactctaagaccgcctactgacaccgtgtcaactcacacacttgggccctatcctataacaccacacttggccacagtggcagtggccccgcttaagcctgtatgcgcataaagggccactgaataacatttacaatacaccggggcacagcttggccccttttacaaacatttcctttgtcaacccctcatggcaacgccacaacatccctagtcgaccgtgaccaccattctggccttcaacaacaactagttgtcaccccataagcgcttgcgctgccccgaccatgagccattagt

SEQ ID NO: 362222 - DNA, 1829 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctgcagcaggcggtcacaggcatttccaatgcagcccaggccactgcctcagacgatgcctcacagcaccagggtggaggaggaggagaactggcatatgcactcaataactttgacaaacaaatcattgtggaccccttgagcttcagcgaggagcgctttaggccttccctggaggagcgtctggaaagcatcattagtggggctgccttgatggccgactcgtcctgcacgcgtgatgaccgtcgtgagcgaattgtggcagagtgtaatgctgtccgccaggccctgcaggacctgctttcggagtacatgggcaatgctggacgtaaagaaagaagtgatgcactcaattctgcaatagataaaatgaccaagaagaccagggacttgcgtagacagctccgcaaagctgtcatggaccacgtttcagattctttcctggaaaccaatgttccacttttggtattgattgaagctgcaaagaatggaaatgagaaagaagttaaggagtatgcccaagttttccgtgaacatgccaacaaattgattgaggttgccaacttggcctgttccatctcaaataatgaagaaggtgtaaagcttgttcgaatgtctgcaagccagttagaagccctctgtcctcaggttaaagtacaactgacactggtgacagcataaccaaattaaattttgattcaagtggagatgaggtttattttgttaagttttgttttgtttttaggattttagatggaagtcttggggacagatcactgacacagaacccacatagtttggaatattttttgtttaacattaagtgacatttgcacgggagattacatgttactcctggcccttcattgaaaatgcacagtgggctgggcacggtggctcacgcctgtaatcgcagcactttgggatcccaaagtggatgggtcagttgagcccaggaatctgagaccagcctgggcaacatagcaaaacaccatctctt

SEQ ID NO: 362223 - DNA, 885 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggcgagaagggaatttggctcaacttcagttgagagggtgcagtccagacagcttgactgcttttaaatgaccaaagatgacctgtggtaagcaacctgggcatcttaggaagcagtccctggagaaggcatgttcccagaaaggtctctggagggacaaactcactcagtaaaacataatgtatcatgaagaaaactgattctctatgacatgaaatgaaaattttaatgcattgttataattactaatgtacgctgctgcaggacattaataaagttgcttttttaggctacagtgtctcgatgccataatcagaacacactttttttcctctttctcccagcttcaaatgcaaattcatcattgggctcacttctaataactgcagtgtttcccgccttgggcttgcagcagaaaaacctgacaacatagtgtttgctaaggcagtaatttagactttaccttatttgtgattactgtagtgattgattgattgattactattaactacaaggtataatttactatcaccttatttaaattttatgaattaatttgaatgttttttacactaactaacttttcccaataaagtccactatgaaaccacgaca

SEQ ID NO: 362224 - DNA, 895 bp, Homo sapiens
  misc_feature (19)..(19): n is a, c, g, or t
  misc_feature (22)..(22): n is a, c, g, or t
  misc_feature (849)..(849): n is a, c, g, or t
  misc_feature (856)..(856): n is a, c, g, or t
  misc_feature (883)..(883): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtggaagatggtatcttgaagttgaggaatgctggcaatgaacaagacttaggaatccagtataaagccctaaaacctgaagtggataagctgaacattatggcagccaaaagacaacaggaattgaaagatgttggccatcgtgatcagatggctgcagctagaggaatcctgcagaagaacgttccgatcctctatactgcatcccaggcatgcctacagcaccctgatgtcgcagcctataaggccaacagggacctgatatacaagcagctcacagcggtacagcattncatgcanccaagccactgcttaaacatcctacanaccaggtggaga

SEQ ID NO: 362225 - DNA, 1010 bp, Homo sapiens
  misc_feature (19)..(19): n is a, c, g, or t
  misc_feature (22)..(22): n is a, c, g, or t
acggctaggtacgaggctnggngttgaatcggccgaggcgtctgcttcgggcctctggaatttagcgctcgcccagctagccgcagaaatgactgctgtccatgcaggcaacataaacttcaagtgggatcctaaaagtctagagatcaggactctggcagttgagagactgttggagcctcttgttacacaggttacaacccttgtaaacaccaatagtaaagggccctctaataagaagagaggtcgttctaagaaggcccatgttttggctgcatctgttgaacaagcaactgagaatttcttggagaagggggataaaattgcgaaggagagccagtttctcaaggaggagcttgtggctgctgtagaagatgttcgaaaacaaggtgatttgatgaaggctgctgcaggagagttcgcagatgatccctgctcttctgtgaagcgaggcaacatggttcgggcagctcgagctttgctctctgctgttacccggttgctgattttggctgacatggcagatgtctacaaattacttgttcagctgaaagttgtaagtatacaggcctatgtctgtaatttgttctatcacaggaagattgctactggccttccttagttcagtattccttaggatttagtttggttttgaatttggtttatctcaatggaccagagatgtttttgtttaatttccacttactcctctattccaagtatatatcatcctggctctgttctgagccagtgttgtcttggctgtaatgaagaacttgtagcaaagatactgttttgactccttccctttttccagtaatgattaaatattttccttgtagagttctggagttgagaaaccaagaatgtgctttgttaaacagatgcttgaaggcagcatgctcgttaagagtcatcaccactccctaatctcaagtacccagggacacaaacactctgcctaggaaaaccagagacctttgttcacttgtttatctgctgaccttccc

SEQ ID NO: 362226 - DNA, 438 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataaggtactcagtctttgcttaaaataaattttacgtttatcaaa

SEQ ID NO: 362227 - DNA, 980 bp, Homo sapiens
  misc_feature (3)..(3): n is a, c, g, or t
  misc_feature (26)..(26): n is a, c, g, or t
  misc_feature (33)..(33): n is a, c, g, or t
  misc_feature (85)..(85): n is a, c, g, or t
ggngcctgaattctcagttccccggnggtttangccagaaaattccttgaacccggaagccaggggttccagtgagccaagatcncacttattgcattccatcctgggctacagtagagcgagactccatctcagaaaaaaaaaaagatacaactataaaagatacctcataaagaacacggattcactaggaagaggcgtcattaactgtgcccttttagaatattttgtccattaacttaaatatatttaaaaccaactaattggccgggcatggtggctcacgcctgtaatcccagcactttgggaggccaaggcgggcagatcacaaggtcaggagttcgagaccagcctggctaatatagtgaaaccccatttctactaaaaatgcaaacattagtcaggcatggtggcaggtgcctgtagtcccagctacttgggaggctgaggcaggagactctcttcaacccgtgaggcagaggttgcagtgagtcgagatcatgtcactgcacttcagcttaagcaacagagcgagactccatctcaaaaaaagaaaagcacgtcactcgatgttctttctttcataagagttgaagaactaggtatatctgcttatattatggcatctatagtagcttagctgctcatatttgggtctctttagaaccagtgtctttcaaagagggttttaactatgctggtgtaaattttaagaatagatacattcaaagaagaattcaacattcatgtgacattcatactttggaactttgggaaagtataggaatgaccatagattggcttagggatagtcaatttacctgtctgtaaatggatccaatttagtattgttcctgtatttttctaagaccaacacttgtgtcattcacagttaaatatatgagttgtggccaggcccggtggctcatgcctgtaatttcagcattttaggaggctgaggtgaacagattgctcaagtc

SEQ ID NO: 362228 - DNA, 365 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataaggtactcagtctttgcttaaaataaattttacgtttatcaaa

SEQ ID NO: 362229 - DNA, 451 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaacttttttttttttttttttttttttaggtaccagcatcaagatgatttatggtaataaggtactcagtctttgcttaaaataaattttacgtttatcaaa

SEQ ID NO: 362230 - DNA, 298 bp, Homo sapiens
tccgggaggcgaaggtcacgagtggtattcagttaagagaacaattatttcgtataagccacatcagagacgactgaagatgaaaaaactaccatccccgtatataactaatttgtgctgtgcaccaacaagaacctgctttaaatttccatggcaatttacaacccccatactgtaccaggcaaggtctctatgaataaagaaaagcaaatagaatcttatcaggtaccagcatcaagatgatttatggtaataaggtactcagtctttgcttaaaataaattttacgtttatcaaa

SEQ ID NO: 362231 - DNA, 201 bp, Homo sapiens
cgtcgacagatgaagtctgtcacccaggctggagttcagtggcacaaatatatagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaa

SEQ ID NO: 362232 - DNA, 2242 bp, Homo sapiens
aaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362233 - DNA, 2149 bp, Homo sapiens
aaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagca

SEQ ID NO: 362234 - DNA, 2260 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362235 - DNA, 2701 bp, Homo sapiens
tactgccccgccccccccaaaaaatttctggtctgtctttagcttcatttctgaacattttatcctggacctctctttcttcaagtagaaataatcggctgggcgtggtggctcatgcctgtaatctcagcaccttgggaggccgaggcgggtggatcacctgaggtcgagagttcaagaccagcctgaccaacatggagaaaccccgtctctactaaaaatacagaattagccgggcgtggtggcgcatgcctgtaattccagctaattgggaggctgaggcaggagaatcgcttaaacctggaagatggaggttgcggtaagctgagatcgtggaattgcacttcaccctaggcaacaggagcaaaactgtctcaaaaaaaaaaaaaataatcgcagtctttaagttacacataccataaaatatatgagaatttttcttggaccctaggagtgattttttttttccactttttttttttttttcactttaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362236 - DNA, 2314 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362237 - DNA, 2439 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaacttttttttttttttttttttttttaggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362238 - DNA, 2353 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362239 - DNA, 2742 bp, Homo sapiens
tactgccccgccccccccaaaaaatttctggtctgtctttagcttcatttctgaacattttatcctggacctctctttcttcaagtagaaataatcggctgggcgtggtggctcatgcctgtaatctcagcaccttgggaggccgaggcgggtggatcacctgaggtcgagagttcaagaccagcctgaccaacatggagaaaccccgtctctactaaaaatacagaattagccgggcgtggtggcgcatgcctgtaattccagctaattgggaggctgaggcaggagaatcgcttaaacctggaagatggaggttgcggtaagctgagatcgtggaattgcacttcaccctaggcaacaggagcaaaactgtctcaaaaaaaaaaaaaataatcgcagtctttaagttacacataccataaaatatatgagaatttttcttggaccctaggagtgattttttttttccactttttttttttttttcactttaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtgagtggtattcagttaagagaacaattatttcgtataagccacatcagagacgactgaagatgaaaaaactaccatccccgtatataactaatttgtgctgtgcaccaacaagaacctgctttaaatttccatggcaatttacaacccccatactgtaccaggcaaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362240 - DNA, 2426 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtctctatgaataaagaaaagcaaatagaatcttatcaggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362241 - DNA, 2263 bp, Homo sapiens
  misc_feature (2252)..(2252): n is a, c, g, or t
aaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttgaatgtagaccnactggtccgct

SEQ ID NO: 362242 - DNA, 2188 bp, Homo sapiens
aaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362243 - DNA, 2188 bp, Homo sapiens
aaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362244 - DNA, 2732 bp, Homo sapiens
  misc_feature (2330)..(2330): n is a, c, g, or t
  misc_feature (2605)..(2605): n is a, c, g, or t
  misc_feature (2678)..(2678): n is a, c, g, or t
  misc_feature (2682)..(2682): n is a, c, g, or t
  misc_feature (2704)..(2704): n is a, c, g, or t
aaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccataaaaaaaaaaaaaaaaaaaaaaaaaaaaaaaaaaaaaaaaaaaaaaaaaaaaaaaaaaaaaaaaaaaaagggaggggcggacgaatcacaaaagaattcaatcacaggcaggggccacgcaatcacggagcgagcacgcccagtctggttagaacgaggaaggcccaccacatagatgaggccgcatgtctaacgagaagcgcacggcgacagagcatccatacaacaagctcggctgaagagcatcacaggtgaaaactggtggaaccatcttagcgaggacaccacacacatacgggaaggcggcaaaactcgaggcgagacgcgctacacacgaagaagatgaaatcgacacacagcggaaaacacacaaagacgtacgcagagcgcacacagcggtgaccaacaacaagcaacaaatagagacagacagacagagcaaagaaaaaaatcgagaccaatacacgaaaagtatcagctaccagcacagacaactaaccatcaacacgagcagcagacaagagccagaacacacagaaaaccacaagaacatacaaaacagcaacagaaacacgacaagcaagcaacagaacagactcgacagaagctaaagcgacaacaggaacaataacagcgacataggaacacgactaacgcagatcagtcagacagacgagacaacagacagaagtaacagtacgatcagacaagaactaaactagcaagagagaccgagagagagagacgaacgacagcagaggtaacgaagacaggagaggtacgaaaagcgagaggagacagtacaacacagaaaaggagcacgacaggagactgtaagagagagctacgagcatgcagatcagagcacgcaacagcagaagacaagagacgatgaatagccgtacggaaagcgatacatgcaggaacaagctgcgcacgtagcagaagagctagtgcagtagagncgtggagaaccgagctgaaagaagacacgagcaaccgagaacagaataagactagcgaggagacaagacagcggagactcagacgaacgacaaagcacagcagaacgagcacgacaagaagctgacagacgagacaggacggactaagatggcgaagcgagcgagacgcgcacagtgaacacagagcgacacgacggatcgagcgtcggacaggagagcgaagcaggagtgacaggcatgaaagcaagagaccgatagaaaggacgaggcgtagnatgagcagcaatcggccgcgataggcactacatgatcatagtaggaacgcagacgaacaagacagaatgatantgcngagccaatacgaagacgagcangagagctgaggagtagccgcagaggcag

SEQ ID NO: 362245 - DNA, 1394 bp, Homo sapiens
aaacagcttcttaggattaatgtaatatatatatgcaaaggtcaaatgaaatatttttgtggatggtaagaaaaatttcaacttacatttttgcaacttctttaacgatatcacggcaggtcatttctttcatctatagaaaataaaatgtatactgttcatcagaagaacattttccacttgtgtaataactattttcacttttatactcagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaactctagcctgggcgacagagagagagactgtct

SEQ ID NO: 362246 - DNA, 1675 bp, Homo sapiens
tactgccccgccccccccaaaaaatttctggtctgtctttagcttcatttctgaacattttatcctggacctctctttcttcaagtagaaataatcggctgggcgtggtggctcatgcctgtaatctcagcaccttgggaggccgaggcgggtggatcacctgaggtcgagagttcaagaccagcctgaccaacatggagaaaccccgtctctactaaaaatacagaattagccgggcgtggtggcgcatgcctgtaattccagctaattgggaggctgaggcaggagaatcgcttaaacctggaagatggaggttgcggtaagctgagatcgtggaattgcacttcaccctaggcaacaggagcaaaactgtctcaaaaaaaaaaaaaataatcgcagtctttaagttacacataccataaaatatatgagaatttttcttggaccctaggagtgattttttttttccactttttttttttttttcactttaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtggtctctatgaataaagaaaagcaaatagaatcttatcagataagtgcttttataagtctaaatatattctttggaatctctaaagcaaaacttttaaacttttttttttttttttttttttttaggtaccagcatcaagatgatttatggtaataaggtactcagtctttgcttaaaataaattttacgtttatcaaagtaaaatttaccagctttttttcctaaagaggctagtcatatctcatcagtggttacaaagtatccttacaattgaacctacatttgttaatcctgttcagtgtgtatgaaaatcacttggtggccgggcatggtggctcacgcctgtaatcccagcactttgggaggccaaggcgggcagatcacaaggtcaggagttcgagaccagcctggctaatatagtgaaaccccatttctactaaaaatgcaaacattagtcaggcatggtggcaggtgcctgtagtcccagctacttgggaggctgaggcaggagactctcttcaacccgtgaggcagaggttgcagtgagtcgagatcatgtcactgcacttcagcttaagcaacagagcgagactccatctcaaaaaaagaaaagcacgtcactcgatgttctttctttcataagagttgaagaactaggtatatctgcttatattatggcatctatagtagcttagctgctcatatttgggtctctttagaaccagtgtctttcaaagagggttttaactatgctggtgtaaattttaagaatagatacattcaaagaagaattcaacattcatgtgacattcatactttggaactttgggaaagtataggaatgaccatagattggcttagggatagtcaatttacctgtctgtaaatggatccaatttagtattgttcctgtatttttctaagaccaacacttgtgtcattcacagttaaatatatgagttgtggccaggcccggtggctcatgcctgtaatttcagcattttaggaggctgaggtgaacagattgctcaagtc

SEQ ID NO: 362247 - DNA, 879 bp, Homo sapiens
tactgccccgccccccccaaaaaatttctggtctgtctttagcttcatttctgaacattttatcctggacctctctttcttcaagtagaaataatcggctgggcgtggtggctcatgcctgtaatctcagcaccttgggaggccgaggcgggtggatcacctgaggtcgagagttcaagaccagcctgaccaacatggagaaaccccgtctctactaaaaatacagaattagccgggcgtggtggcgcatgcctgtaattccagctaattgggaggctgaggcaggagaatcgcttaaacctggaagatggaggttgcggtaagctgagatcgtggaattgcacttcaccctaggcaacaggagcaaaactgtctcaaaaaaaaaaaaaataatcgcagtctttaagttacacataccataaaatatatgagaatttttcttggaccctaggagtgattttttttttccactttttttttttttttcactttaggtgagcatttgtacagtgaaacattttgctacacaaaagtgatgtttaggaatactaacaaattattttcaagaataagactgattttatgggaaaattaagcagatgctccagtttgagaaacctggatctgcgatctgtttgtgagtggtattcagttaagagaacaattatttcgtataagccacatcagagacgactgaagatgaaaaaactaccatccccgtatataactaatttgtgctgtgcaccaacaagaacctgctttaaatttccatggcaatttacaacccccatactgtaccaggcaaggtaccagcatcaagatgatttatggtaataaggtactcagtctttgcttaaaataaattttacgtttatcaaa

SEQ ID NO: 362248 - DNA, 326 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggtaccagcatcaagatgatttatggtaataaggtactcagtctttgcttaaaataaattttacgtttatcaaa

SEQ ID NO: 362249 - DNA, 2480 bp, Homo sapiens
agcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtgagtggtattcagttaagagaacaattatttcgtataagccacatcagagacgactgaagatgaaaaaactaccatccccgtatataactaatttgtgctgtgcaccaacaagaacctgctttaaatttccatggcaatttacaacccccatactgtaccaggcaaggtaccagcatcaagatgatttatggtaataagatataaaaccaaggaaaataacctaaagtctgaaaaagaccagaatcgaagtttcctgattcatattttaatgttttgaaatttatactccaggctgggtgcagtggcttgtgcctgtaatcccagcactttgggaggccgaggcggccggattgcctgaagtcagaagttcgagaccagcctgaccaacatggtgaaaccctgtctctacttaaaaatacaaaagagctgggcatggaggtggtgcgcgcctgtaaccctagctactcgggaggctgaggcctaagaatctcttgaacccaggaggcagaggttgtagtgagccgggatcacgccactgcactctagcctgggcgacagagagagagactgtctaaaaaaggaaaagaaaaaaatttatacgccaaaaaagatattctgagataacctgtagttaccactaactttgtgacaaaattataaaaatccacagccatctatgaatctgtaggcagacctgaagtttgaacgactggtgaagacatctgattttctttatagccaagttaggataacaaaatgcaaacaagtcattaatatttactatatgcaagatacagaaagatgaaggaaggagtaagaagttatccttcgtggaactattcaaagcaaaaatgcaaaataccagggaaagctttgaagaaccaagatttgagcaggttcttagaatatagattggattggatttgatttcaagaaagatgaacgtgtaaagcagaagtgggaagccaaaaacttttttccaaattagaattaagcattctttcaatgaacatttggaaatcaaggtagaaaaatatccctagggcctagctgaggagtctgtatgttgttgggttttgatagtaaccagtccaagattttgttattagacgtgggtttctgaatagacaggcatttctgaacagacatgacaggatcaaaacaatgtttgagcaaactgcccttcatctactgtggatatgttgggggatgatggaatatagtgaaagataatgggtgctcatacagcagtctagacttaaggtgattcaactactatatattaaactagattatcttttattttttaattttgaaatctggatgctcaagctctgcctgcacaaccacatgaggaagaaggaacaatgacaacaaaaataacactaaatttaaatttaagagtactacttttaggaaatagacaaaccattatttgggtacaactaaaggcaactggcatggactcaaatattttggggaagaaaaagactaaaagttctaaggaagaaaatgcgaaccttgatagtttgaaatagttaaaaagacagtgtagaaactgtttaggcagtttgattatggactattagatgatacttgggtctgataatggtataaggagaataaagtatttagggatccaatattacgcctgcagctttttccaaatagttcatgggggagggggatgtgtaagtggttaactgaagtctaactagataggtttgttgtaagcttaggatgtttacagttcttcatgttaagttgagcgtgatgggaagggaaagaatgctgatctttaaatttttgtccttagttaagttctgtatttagtgaattaattgcatcctaaaaagtcaaacttgaaaagcacattttaaatggcaaatctattttttacatgtttgtgaagtttttattttttagtaaacagaccatcagaagagaacaatggtacagagcaggggtcagcagatggattttgtaaagcatcaacttgtaaatattttcaagtttattagctgtatggctctggtttctgttccctgttccaaatgttaaagtctactgttgtattctaaaagcagccatggactgaatgtagctgtgttccaataaaacttacacaaaagcaggcagtgggccataatttgcaacacctgattcacagcataattttgtcacaaactgaaagtgttcctcaattaaagtgatttttttttcttga

SEQ ID NO: 362250 - DNA, 2195 bp, Homo sapiens
gcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggtgtggcccgggacctgcaggaggagatgctgccaggaagctctgaggattggctggaacccccaggggcagttgggcgaccagccacagagccccccagggagggcacaaccgagggggatgaggaggatgccacggaggcatggcgcctgcaccagaagcatgtctttgtgctgagtgaggcagggaagcctgtgtactcccgctatgggtctgaggaggcactttccagcactatgggtgttatggtggccctggtgtccttcctggaggcagacaagaacgccatccgctccatccatgcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtaaggcagccctgggatgggctgggctttatggaggtcctaggtatgggccatgaggggcctctaacctagatgacgaccctttgccccttctccaggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaaaaaaaatcaa

SEQ ID NO: 362251 - DNA, 2030 bp, Homo sapiens
gcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggtgtggcccgggacctgcaggaggagatgctgccaggaagctctgaggattggctggaacccccaggggcagttgggcgaccagccacagagccccccagggagggcacaaccgagggggatgaggaggatgccacggaggcatggcgcctgcaccagaagcatgtctttgtgctgagtgaggcagggaagcctgtgtactcccgctatgggtctgaggaggcactttccagcactatgggtgttatggtggccctggtgtccttcctggaggcagacaagaacgccatccgctccatccatgcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggatgaaagagcagaattttgcgaataataccatgatgattaaagcaaacatggagacaaagaaataagaagcaaagaagcccataaattaaaaatgaatagaatggaataagacaaaaaggaaagaaagaaatattaattcataagaccataaaatattgcctgagaatgtgtgaccgagtagacttttggacaataggtgtggaaaaaatagcagcctaaatgg

SEQ ID NO: 362252 - DNA, 1288 bp, Homo sapiens
aagagctgcgctggaaggcggttttcggagggagctgccgctgaggctgacatccttctttcctgtcccgctctcagatggcatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaaaaaaaatcaa

SEQ ID NO: 362253 - DNA, 874 bp, Homo sapiens
gcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggttggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagtcagccttcctggacacactaggtgtgggaagccataggagcctccagatgggggctggcctctcttgcccagccagcgggcagggactgtgggttggtgaatgcattaaagtgctttggggaaaaaaaatcaa

SEQ ID NO: 362254 - DNA, 2097 bp, Homo sapiens
gcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggtgtggcccgggacctgcaggaggagatgctgccaggaagctctgaggattggctggaacccccaggggcagttgggcgaccagccacagagccccccagggagggcacaaccgagggggatgaggaggatgccacggaggcatggcgcctgcaccagaagcatgtctttgtgctgagtgaggcagggaagcctgtgtactcccgctatgggtctgaggaggcactttccagcactatgggtgttatggtggccctggtgtccttcctggaggcagacaagaacgccatccgctccatccatgcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaaaaaaaatcaa

SEQ ID NO: 362255 - DNA, 1997 bp, Homo sapiens
tgaagacgggggcctccagccatcaacgctatcgtttgcaatgggaagactgtgtctccctgcggtccctcagccggctagtccccagctggggaatacaaaaggcgagatctggaacccatcctttggctgggagggcgagatccggtagggggcagtggccaggagagctcaaaggatggctactgacatgcagaggaagagaagcagcgaatgccttgatggcacattgactccttctgatggacagagtatggagagagctgagagccccacaccaggaatggcccagggaatggagccaggtgcgggccaggagggtgccatgttcgtccatgcccgttcctacgaggacctgactgagtcagaggatggggcagcttctggggacagccacaaggagggtaccaggggtcccccgccgctgcctacagacatgcgccagatcagccaggactttagcgagctaagcacccagctgacgggtgtggcccgggacctgcaggaggagatgctgccaggaagctctgaggattggctggaacccccaggggcagttgggcgaccagccacagagccccccagggagggcacaaccgagggggatgaggaggatgccacggaggcatggcgcctgcaccagaagcatgtctttgtgctgagtgaggcagggaagcctgtgtactcccgctatgggtctgaggaggcactttccagcactatgggtgttatggtggccctggtgtccttcctggaggcagacaagaacgccatccgctccatccatgcagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaaaaaaaatcaa

SEQ ID NO: 362256 - DNA, 1611 bp, Homo sapiens
gcgggccgagtcgggctgagcggctggagctgggccttggccgcgagaggccggcgaaagctatcttcctgcaccggcggccgggtgagggcggtgggagggagcggtgcctgcgctgtggccatgtctgtgtacgcagggggccggggccccgcgaagctgtgccctcaggccggccccggccggacacccttacccctccatgggtccggcagagggcagtgaccggcaccttctgtgcgtcctggactcctctgagaaacaggagagctcaaaggatggctactgacatgcagaggaagagaagcagcgaatgccttgatggcacattgactccttctgatggacagagtatggagagagctgagagccccacaccaggaatggcccagggaatggagccagatggctacaaggtagtattcgtgcgccggagcccgctggtgctagtggcggtggctcgtacgcggcagtcggcacaagagctggcgcaggagctgctctacatctactaccagatcctaagccttcttaccggtgcgcagctgagccacatcttccagcagaagcagaactatgatttgcggcgcctactctcgggctcagagcgcatcaccgacaacctgctgcagctcatggcacgagaccccagcttcctgatgggggcggcacggtgcctgcccctggcggcggccgtgcgcgacactgtgagcgccagcctgcagcaggcgcgtgcgcgcagcctggtcttctccatcctgctggcccgcaaccagctcgtggcactcgtgcgccgaaaggaccaatttctgcaccccatcgacctgcacctgctcttcaacctcattagttcctcctcgtcctttcgcgagggcgaggcctggacgcccgtgtgcctgcccaaattcaacgcagccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaaaaaaaatcaa

SEQ ID NO: 362257 - DNA, 953 bp, Homo sapiens
  misc_feature (54)..(54): n is a, c, g, or t
gacaagaacgccatccgctccatccatgcagatggctacaaggtagtattcgtntgcctgcccaaattcaacgcagccggcttcttccacgcacacatctcttacctagagcctgtgcagacattcaattgttatatggctacaaggtagtattcgtgcgccggagcccgctggtgctagtggcggtggctcgtacgcggcagtcggcacaagagctggcgcaggagctgctctacatctactaccagatcctaagcccggcttcttccacgcacacatctcttacctagagcctgacactgacctctgcctgctgcttgtctccactgaccgtgaggacttctttgcagtctctgactgccgccgccgcttccaggagcgccttcgcaagcgcggagcccacctggccctgcgagaggcactgcgcacaccctactacagcgttgcccaagtgggcatccctgacctgcgtcacttcctctataagtcaaagagctcgggactcttcaccagccctgagattgaggccccatacaccagtgaagaggagcaggagcggctgctgggcctctaccagtacttgcacagtcgtgcccacaatgcctctcgcccactcaagaccatttactacacgggccccaacgagaacctcctggcctgggtgacaggcgcctttgagctctacatgtgttacagccccctggggaccaaggcgtcagccgtcagtgccatccataagctgatgcgctggatccgcaaagaggaagaccgcctcttcattctcacgcccctcacctattgatgggaatgtgtgcgggctcagccttcctggacacactaggtgtgggaagccataggagcctccagatgggggctggcctctcttgcccagccagcgggcagggactgtgggttggtgaatgcattaaagtgctttggggaaaaaaaatcaa

SEQ ID NO: 362258 - DNA, 369 bp, Homo sapiens
acgtccgcctagcccttcgctgccgcctgccctcggcctgacctccgccggccccttctccccctggccattcagggtagccctggctttgcagcgcgccagggaagaggacgccgcttcccccgtcctgtccctactcaggtgtgcaccccttgctcgggcccgcgcccccaccctgggcagagcatagagatcactccttgttttcacgtttaaatgagatgcaagcaaaaggctggcgcagaataggcgctgcacacttgttcataagcacttggtagaatcacatagtagatgattaatattgactgaaaagtctagtacccagtaagcactcaaaacctggtgaaaataaagcgtctgtccaca

SEQ ID NO: 362259 - DNA, 643 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccaggtactggggtgcaaccaagatcacaaaagtccctgtcctcacggagctcacacagtcatcggggggggaagacagacatgctaagtgatctagaatgtgagatcaggtgttgacaagaaccctggagggaggagagcagggaaaggtcagaaagggaagacccagggtctctgaaggaggtatcaggaaagaagtctaaggatgccctgatgtgagcaggacctgagggcagtgtggagggggccgtgcggacccctggggaagaggaatccaaaaagaaaaatgccaaggtcagaagtgttgaaggaatgggggtcatgctgc

SEQ ID NO: 362260 - DNA, 291 bp, Homo sapiens
ggactcatgaaactgaggtgtagataacagacccgggtctctagaaatggaaagaatattttcgcactctgtgattgaatactggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362261 - DNA, 2080 bp, Homo sapiens
  misc_feature (2076)..(2076): n is a, c, g, or t
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaaaaaaaaaaacacacacaaaaaaacnaaaa

SEQ ID NO: 362262 - DNA, 2187 bp, Homo sapiens
  misc_feature (2124)..(2124): n is a, c, g, or t
  misc_feature (2126)..(2126): n is a, c, g, or t
  misc_feature (2132)..(2132): n is a, c, g, or t
  misc_feature (2138)..(2138): n is a, c, g, or t
  misc_feature (2183)..(2183): n is a, c, g, or t
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaaagaaaaaaaaaagaaaaaaaagaaaaagaaagaaaaagaaaaaaaaaaaaaaaaagaaaaaaacgccaaaaaananaaaaanaaaaanaaaaaaacaaaagaggtgtaaaaaaaaaacacacacaaaaaaacnaaaa

SEQ ID NO: 362263 - DNA, 1560 bp, Homo sapiens
gctcggtacccctctatccttaatctggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362264 - DNA, 1771 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362265 - DNA, 1984 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362266 - DNA, 1959 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatccatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362267 - DNA, 1435 bp, Homo sapiens
catcctgctgggggaagtactcaatgcccaccctccctctcatctcctgaatcctcccaccccatcctgatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362268 - DNA, 2450 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctgtgagtatcttttgttcctctgtgggccaggacaccagcttaaatccaaaccaccagaggccaggtctctcagtctctctccagtccaagtatagacacctttacttctggacatccgaggtggccatgactccctgccctgggaaaacctaggtaggcacagccttaaccaagaatataaggggaggggacgctcttgtcatgggagacttggggcctaaaacttgtgatgggagaaacaggtgaatacctcaggcttcggctcagtgaacatagagggagtttggctgggacttgaaggtgtgtcttggcttagagggtaactgtgtccctttaagagaccaggaacatccccttccctcggatgacatcacctatggctttattctctttgcgccagatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362269 - DNA, 2171 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctgtgagtatcttttgttcctctgtgggccaggacaccagcttaaatccaaaccaccagaggccaggtctctcagtctctctccagtccaagtatagacacctttacttctggacatccgaggtggccatgactccctgccctgggaaaacctaggtaggcacagccttaaccaagaatataaggggaggggacgctcttgtcatgggagacttggggcctaaaacttgtgatgggagaaacaggtgaatacctcaggcttcggctcagtgaacatagagggagtttggctgggacttgaaggtgtgtcttggcttagagggtaactgtgtccctttaagagaccaggaacatccccttccctcggatgacatcacctatggctttattctctttgcgccagatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362270 - DNA, 1692 bp, Homo sapiens
  misc_feature (1692)..(1692): n is a, c, g, or t
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttcgcgagctcgcgaacgtgtaatccctattcccgttctcttcctctccggaaacatgttttcacaagaatggtccatagtccatctaatttcgtatccatn

SEQ ID NO: 362271 - DNA, 1655 bp, Homo sapiens
agaagaaattcgacatttcaccttcaccttatacttggagactcccaagccctacatctccagcagcaacttaaaccccagggaggccatggaggctgtgcgcttaatctgtgatcctgagactctggacgcaagctacctatggtggatgaatggtcagagcctccctgtgactcacaggttgcagctgtccaaaaccaacaggaccctctatctatttggtgtcacaaagtatattgcaggaccctatgaatgtgaaatacggaacccagtgagtgccagtcgcatgacccagtcaccctgaatgtcctctgtgagtatcttttgttcctctgtgggccaggacaccagcttaaatccaaaccaccagaggccaggtctctcagtctctctccagtccaagtatagacacctttacttctggacatccgaggtggccatgactccctgccctgggaaaacctaggtaggcacagccttaaccaagaatataaggggaggggacgctcttgtcatgggagacttggggcctaaaacttgtgatgggagaaacaggtgaatacctcaggcttcggctcagtgaacatagagggagtttggctgggacttgaaggtgtgtcttggcttagagggtaactgtgtccctttaagagaccaggaacatccccttccctcggatgacatcacctatggctttattctctttgcgccagatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362272 - DNA, 2099 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgccaacatggtc

SEQ ID NO: 362273 - DNA, 925 bp, Homo sapiens
tagaggatccctatcagagcatacccctactcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362274 - DNA, 2499 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctgtgagtatcttttgttcctctgtgggccaggacaccagcttaaatccaaaccaccagaggccaggtctctcagtctctctccagtccaagtatagacacctttacttctggacatccgaggtggccatgactccctgccctgggaaaacctaggtaggcacagccttaaccaagaatataaggggaggggacgctcttgtcatgggagacttggggcctaaaacttgtgatgggagaaacaggtgaatacctcaggcttcggctcagtgaacatagagggagtttggctgggacttgaaggtgtgtcttggcttagagggtaactgtgtccctttaagagaccaggaacatccccttccctcggatgacatcacctatggctttattctctttgcgccagatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgccaacatggtc

SEQ ID NO: 362275 - DNA, 1445 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttca

SEQ ID NO: 362276 - DNA, 1163 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcattacccttctgtcgtcttctcgagtcctctaatc

SEQ ID NO: 362277 - DNA, 1038 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaacggtcagagcctccccgtcagtcccggggtaaagcgacccattgaaaacaggatcctcattctacccagtgtcacgagaaatgaaacagga

SEQ ID NO: 362278 - DNA, 848 bp, Homo sapiens
tacccggtgcttatcgatgccacctgtgaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362279 - DNA, 1227 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccgtgagtatcctctgttcctctgtgagccaggctgccatcccaaatacacatggccagaggccaggcctctcagtccctctcaggtccaagtacagagacctttacccctggacatcaaagctggccatgactttctgccccaggcaaaacagagtaggcctaggcttgatccacaataggagaaaagaggctgctcctgtcatgggagactcaggttccacagcttgtgatgggagaaacaggtgaatgtctcaggctccagatcagtgaacacagcggggatttggctgggacttcagtgagtgccagccacagtgacccagtcaccctgaatctcctccgtgagtatcctctgttcctctgtgagccaggctgccatcccaaatacacatggccag

SEQ ID NO: 362280 - DNA, 1043 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtcaagctcacattgcatgcagctcagatctactagaggatctccctggaagaatttcctgcatggtgatcgatcattaagctcaatgtaaattgcagggagtatcgggaggcaaaaaaatgcaaatgcagatggtgggtgtgacatacacggttacagaagtgtaaggtaacagatcagaggcgtacacgtctcagcaagggttgaatgagcaattattgacagaataagctctggaacaagtcagaggagttgat

SEQ ID NO: 362281 - DNA, 1108 bp, Homo sapiens
tcacgggacaaaggtatggatggtggcagcacttcttaacgatccactgatattaagcagcgacacctggttcccaccacctcgtggaattcaaggcctcaaaatttcgagtcaggatgtatttgtagtatttcttctgcatggggcttagctccacccgaacgatgagctctgtcttggctggcatgttcttaaagacatctgccttgagtctccgcagcatgtgtggccccagcaaatcatgcagtttcttgatctggtcctctttggatatgtcagcaaactcctccaggaagccctccaagttgttaaatctctctggggtgaggaagttcaggagatggaagagctcctccagattattctgcaatggggttcctgtcagcagcaacttatgatctatcttgtaaccattgagaacactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362282 - DNA, 734 bp, Homo sapiens
tcggtaccggtcccatgcacagttaggtcccatcacagttaaagttgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362283 - DNA, 597 bp, Homo sapiens
tggtacctatctgtgtcggggttgcacagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctccgtgagtatcctctgttcctctgtgagccaggctgccatcccaaatacacatggccag

SEQ ID NO: 362284 - DNA, 648 bp, Homo sapiens
  misc_feature (34)..(34): n is a, c, g, or t
gaacaacgagtcacgaattcgagatcggataacntggacatttgacctgaaccttacacatggccagaggccaggcctctcagtccctctcaggtccaagtacagatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccgtgagtatcctctgttcctctgtgagccaggctgccatcccaaatacacatggccagaggccaggcctctcagtccctctcaggtccaagtacagagacctttacccctggacatcaaagctggccatgactttctgccccaggcaaaacagagtaggcctaggcttgatccacaataggagaaaagaggctgctcctgtcatgggagactcaggttccacagcttgtgatgggagaaacaggtgaatgtctcaggctccagatcagtgaacacagcggggatttggctgggacttcagtgagtgccagccacagtgacccagtcaccctgaatctcctccgtgagtatcctctgttcctctgtgagccaggctgccatcccaaatacacatggccag

SEQ ID NO: 362285 - DNA, 2050 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362286 - DNA, 2058 bp, Homo sapiens
gtatcaacgcagagtgcccattacgccggggagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362287 - DNA, 2185 bp, Homo sapiens
agggaaagaaggctctgttggagcctggataggggaaaatacaccagagggtcaaaataggaaagtcacattgaagcggaattggtaagtggtaggaaaatcttaagtgttctgttttcctgattaatcatcaggggccaccatattttgaaaaatgataacaataactatatcagatgacacttcaaatgaaaatataagcaggacatgaaacactgtcctcagcaagaaacctcaacaattggggggaaaaagaaacatccagagggtggagaccctgagaactctcacatctacaggagtctgccgcctgttccagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362288 - DNA, 1899 bp, Homo sapiens
accgatctgactacgcggctgaagggggtcctgcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362289 - DNA, 1483 bp, Homo sapiens
tggtacctatctgtgtcggggttgcacagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362290 - DNA, 1558 bp, Homo sapiens
gtatcaacgcagagtgcccattacgccggggagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362291 - DNA, 2021 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362292 - DNA, 1327 bp, Homo sapiens
tcggtacctgctcgcccctctctgcacattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362293 - DNA, 1771 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362294 - DNA, 1255 bp, Homo sapiens
cgtctagaggatccgatagagcataccctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362295 - DNA, 2003 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctcttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362296 - DNA, 1149 bp, Homo sapiens
gtgtcacagtgcgacgtatacacgaacgttctgtgtagcttaaatagtgtctgatcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362297 - DNA, 1146 bp, Homo sapiens
atatgctgttttcttgccctagagcctggaaagaaggaatcgaaagtgcccagtgcattgataagaacagcagtctggaggcagactccccaatgtagtgcacattcaggtactcaggctcaccatgccttggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362298 - DNA, 983 bp, Homo sapiens
  misc_feature (26)..(26): n is a, c, g, or t
tctagaggatcctgcgggagccttancctccgggagccttaatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccaggataacaagttgatgacttcacactgtggacagtttttccaaagatgtcagaacaagactccccatcatgataaggctcccacccctcttaactgtccttgctcatgcctgcctctttcacttggcaggataatgcagtcattagaatttcacatgtagtagcttctgagggtaacaacagagtgtcagatatgtcatctcaacctcaaacttttacgtaacatctcaggggaaatgtggctctctccatcttgcatacagggctcccaatagaaatgaacacagagatattgcctgtgtgtttgcagagaagatggtttctataaagagtaggaaagctgaaattatagtagagtctcctttaaatgcacattgtgtggatggctctcaccatttcctaagagatacagtgtaaaacgtgacagtaatactgattctagcagaataaaacatgtaccacatttgctaa

SEQ ID NO: 362299 - DNA, 1576 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgccaacatggtc

SEQ ID NO: 362300 - DNA, 2474 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctgtgagtatcttttgttcctctgtgggccaggacaccagcttaaatccaaaccaccagaggccaggtctctcagtctctctccagtccaagtatagacacctttacttctggacatccgaggtggccatgactccctgccctgggaaaacctaggtaggcacagccttaaccaagaatataaggggaggggacgctcttgtcatgggagacttggggcctaaaacttgtgatgggagaaacagtgaacatagagggagtttggctgggacttgaaggtgtgtcttggcttagagggtaactgtgtccctttaagagaccaggaacatccccttccctcggatgacatcacctatggctttattctctttgcgccagatggtccagacctccccagcatttacccttcattcacctattaccgttcaggagaaaacctctacttgtcctgcttcgccgagtctaacccacgggcacaatattcttggacaattaatgggaagtttcagctatcaggacaaaagctctctatcccccaaataactacaaagcatagtgggctctatgcttgctctgttcgtaactcagccactggcaaggaaagctccaaatccatcacagtcaaagtctctggtaagtggatcccagcatccttggcaatagggatttaggtggagtctatctggcattcagggaagagtgaggaaaacatttttattcccagcctgtgtcccatgggcacaagcaaatcccaaattctcctcctgaacactcccaatttgtctaagaacttccaaaactttaacaaacaggctgatatcttcttaaaattcccagcctagaccaagcaggagaaacattgatttcattgaaataattgacaatattgaggataatatttttatgatttttatttgaaaatttgctgattctttaaatggtttgttttctagatttatggaatttttttcttttaatctatctatagcttgtagcagttcaataaactatacttctgggaaccgtaattgaaacatttacttttgctctctacctgactgccccagaattgggcaactattcatgagtattgatatgtttatggtaatacacatatttgcacaagtacagtaacaatctgctctctttgtaacaggacacatttcaaatcattggttatattaccaaggctttgactgggatgttatattcaagaatatagatagaatgaaccaatatgaactgcaggcaaagtctgaagtcagccttggtttggcttcctattctcaagggttttgtaaaagtttaatctgagagtccttataaaaacttagagcaaataaaattctaaaagagcgccaacatggtc

SEQ ID NO: 362301 - DNA, 1164 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctcccaaagctgtccaagccctacatcacaatcaacaacttaaaccccagagagaataaggatgtcttaaccttcacctgtgaacctaagagtgagaactacacctacatttggtggctaaatggtcagagctccctatgactcacaggttgcagctgtccaaaaccaacaggaccctctttatatttggtgtcacaaagtatattgcaggaccctatgaatgtgaaatacggaacccagtgagtgccagccacagtgacccagtcaccctgaatctcctccgtgagtatcctctgttcctctgtgagccaggctgccatcccaaatacacatggccag

SEQ ID NO: 362302 - DNA, 1515 bp, Homo sapiens
  misc_feature (1452)..(1452): n is a, c, g, or t
  misc_feature (1454)..(1454): n is a, c, g, or t
  misc_feature (1460)..(1460): n is a, c, g, or t
  misc_feature (1466)..(1466): n is a, c, g, or t
  misc_feature (1511)..(1511): n is a, c, g, or t
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacacctggagactcccaagccctccatctccagcagcaacttaaatcccagggaggccatggaggctgtgatcttaacctgtgatcctgcgactccagccgcaagctaccagtggtggatgaatggtcagagcctccctatgactcacaggttgcagctgtccaaaaccaacaggaccctctttatatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgcttcacggaatctaacccaccggcagagtatttttggacaattaatgggaagtttcagcaatcaggacaaaagctctttatcccccaaattactagaaatcatagcgggctctatgcttgctctgttcataactcagccactggcaaggaaatctccaaatccatgacagtcaaagtctctggtccctgccatggagacctgacagagtctcagtcatgactgcaacaactgagacactgagaaaaagaacaggctgataccttcatgaaattcaagacaaagaagaaaaaaactcaatgttattggactaaataatcaaaaggataatgttttcataattttttattggaaaatgtgctgattctttgaatgttttattctccagatttatgaactttttttcttcagcaattggtaaagtatacttttgtaaacaaaaattgaaatatttgcttttgctgtctatctgaatgccccagaattgtgaaactattcatgagtattcataggtttatggtaataaagttatttgcacatgttcaaaaaaananaaaaanaaaaanaaaaaaacaaaagaggtgtaaaaaaaaaacacacacaaaaaaacnaaaa

SEQ ID NO: 362303 - DNA, 800 bp, Homo sapiens
ctgccccgggaggaggctcagacagaaggaggaaggacagcacagctgacagccgtactcaggaagcttctggatcctaggcttatctccacagaggagaacacacaagcagcagagaccatggggcccctctcagcccctccctgcacacacctcatcacttggaagggggtcctgctcacagcatcacttttaaacttctggaatccgcccacaactgcccaagtcacgattgaagcccagccacccaaagtttctgaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatccctgctgatccagaatgtcacgcaggaggatgcaggatcctacaccttacacatcataaagcgacgcgatgggactggaggagtaactggacatttcaccttcaccttacaccagtcagaacataacatgaggtctaaactcctgacaactttttatgggaaaattacagtattacgaattgagcatcggaaatccagaaatccacaatctgaaatgctccaaaactcaacccttctgaccactgatgtgatgttaaaaagaagtgctcactggcgcattgtggattttaaatttttcagatttgggatgctaaaccagtacatgtactgcaaatattccaaaattaaaaaaattagaaatcc

SEQ ID NO: 362304 - DNA, 465 bp, Homo sapiens
aactctgattgaagtatgcctgtggaggaatcaaaggtgccacacaggacaatcttctctctgttatccacacagcaaagctgtccaagccctacatcacaatcaacaacttaaaccccagagagaataaggatgtcttaaccttcacctgtgaacctaagagtgagaactacacctacatttggtggctaaatggtcagagcctccctgtcagtcccagggtaaagcgacccattgaaaacaggatcctcattctacccaatgtcacgagaaatgaaacaggaccttatcaatgtgaaatacgggaccgatatggtggcatccgcagtgacccagtcaccctgaatgtcctctgtgagtatcttttgttcctctgtgggccaggacaccagcttaaatccaaaccaccagaggccaggtctctcagtctctctccagtccaagtatagacacctttacttctgg

SEQ ID NO: 362305 - DNA, 5605 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaatggtgggctgggccgaaaattaaaacatggggggggcgaaggagggaggagggcaggacggggaaagggttccaaaaaagggggggttgaacagggggggggaagggc

SEQ ID NO: 362306 - DNA, 5348 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggagtgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtga

SEQ ID NO: 362307 - DNA, 4391 bp, Homo sapiens
ggctgcgtaaaccgggaccacggggaaaagttttaccggagcaataattcgttcgcaaaccccaaacggtcggttcatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaatggtgggctgggccgaaaattaaaacatggggggggcgaaggagggaggagggcaggacggggaaagggttccaaaaaagggggggttgaacagggggggggaagggc

SEQ ID NO: 362308 - DNA, 4011 bp, Homo sapiens
gatcagctcgcccgtctatcttctgaatcccggcatggcagaaaaatggaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaatggtgggctgggccgaaaattaaaacatggggggggcgaaggagggaggagggcaggacggggaaagggttccaaaaaagggggggttgaacagggggggggaagggc

SEQ ID NO: 362309 - DNA, 4149 bp, Homo sapiens
agggctctgaaattgttatatgtttcactttattatttctaattactgttttcaatagtacatatatttttgcaacagtgatttttttttaattggaccatagttttaaaaaaattaatctttaagctggttttgatgatttggatactatctgaacctagtcttggtattccactcagcagccacagacagcctctttttgatgaacaaggccttgaatctgtaagactccctcatcctgccttcgggttttggagtaattcacccaaaacaagcttggtaaggttggatcagggtgaagaaaagaaaaatagagctgtaaataagtgaagacaagtccaggaagggacatgcaaattccaaaattgtgcaatataaatttagaaatatatcaaggttaaccttatctgtgttcaattttgtgtctgtacagtggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaatggtgggctgggccgaaaattaaaacatggggggggcgaaggagggaggagggcaggacggggaaagggttccaaaaaagggggggttgaacagggggggggaagggc

SEQ ID NO: 362310 - DNA, 2017 bp, Homo sapiens
cggggtgactctacaggatctcggcagctatccggttccctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaatggtgggctgggccgaaaattaaaacatggggggggcgaaggagggaggagggcaggacggggaaagggttccaaaaaagggggggttgaacagggggggggaagggc

SEQ ID NO: 362311 - DNA, 1571 bp, Homo sapiens
cttggctcagtaaatcctctgcctcccgacctcaagcaatcctcccacctgagcctcctgagtagctgggactacaggcgtgcaccaccacacccagctaatttttgcattcgtttgtagagacagggtttctccatgttgcccaggcttgtcttgagtgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaatggtgggctgggccgaaaattaaaacatggggggggcgaaggagggaggagggcaggacggggaaagggttccaaaaaagggggggttgaacagggggggggaagggc

SEQ ID NO: 362312 - DNA, 1380 bp, Homo sapiens
gagaatgtgtgttccatcaaaaatatttaaaatacagaattttttgggatggtaaaaaaaaaaaaaaaaaaaaaaaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtgaaaaaaaaaaaaaaaaaaaaatggtgggctgggccgaaaattaaaacatggggggggcgaaggagggaggagggcaggacggggaaagggttccaaaaaagggggggttgaacagggggggggaagggc

SEQ ID NO: 362313 - DNA, 2523 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaagggtttcgatgacagggtttagatgaagggtttgatgagggttgatgagggtttgatga

SEQ ID NO: 362314 - DNA, 1050 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaatatgttatgttgcccatctttaaactctctatcctttccagtttctcctctccttttctaattttcttattttgttctgtattccttatccataggataactcttggaattactctcttttagggatgtgctgtccaatatgggccatgtgactattgagcacttaaaatgtgactggcccaaattgtaatgtgctgtatgcacgttgaatgtgtaatatatgcaccagatttgaaaaacttaatatgaaaaatgcaaaatatgaccttaatgttttttgtgatcattgcatgttaaaataatattttagatatcatagattaaataaaatatacttgttt

SEQ ID NO: 362315 - DNA, 292 bp, Homo sapiens
tgcctcttttagcataatcacattttctaaatgattttctttgttcctgaaaaagtgatttgtattagttttacatttgttttttggaagattatatttgtatatgtatcatcataaaatatttaaataaaaagtatctttagagtgaccctttccccatagatttttatttctctattatattttacaaggaatataactcagtttgttagggagagtgccttaaaggcaggtgtttcttggactttgttatttaattagatctgcttgcaataaaaaaagttgtcggtta

SEQ ID NO: 362316 - DNA, 5477 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcataattttcaaagactaatttcttgactgaagatattttgctagggaagtgaaactttaaaattttgtagattttaaaaaatattgttgaatggtgtcatgcaaaggatttatatagtgtgctcccactaactgtgtacagatcaggacacatatttttagacatctaagtctgtagcttaaatggaggttactcttccatcatctagaattgtttacttagtaattgttgtttcttttattattatagacttactatcagttttattttgccaagtatgcaacaggtatatcactagtatatgaaaatgtaaatatcacttgtgtactcaaacaaaagttggtcttaagcttccaccttgagcagccttggaaacctaacctgcctcttttagcataatcacattttctaaatgattttctttgttcctgaaaaagtgatttgtattagttttacatttgttttttggaagattatatttgtatatgtatcatcataaaatatttaaataaaaagtatctttagagtga

SEQ ID NO: 362317 - DNA, 5225 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatcagtaataatttgtataaatatttcccacaacaattttcttaatccagtctatcactgatagacatttgggttggttccaagtctttgctattgtgaacagtgcttcttggtgccatatttttaacggcacatactcactttgtgtcacattttggtaattctcacaatatttcaaactttttcagtatcatcatgtctgttgtggtatctgtgatcagtgatggtactactcgaattgctttggggtgccacaaaccacacccatataagacagtgaacacagtatagtgtgtctgttctgactgctcatacgtcg

SEQ ID NO: 362318 - DNA, 5186 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatcctgataaaacaagatacatagagagtcaatctggcttctgagaatttaccaagtgaacagagtacctagttcatcagccgtccagtaaagcaacccaggaaactgactgggtctctttgcctaccgtattaacattaaacattgatgttctgtattctgtactttactgcacccagcagactttcaacaactcattgatccaaagatacatgcacagtctgagcaccagctatggtgctcataacttctttaagacttgaaccctttcaatctgtgtgattcattaaattggaccattgatgataagaatacacattgtatgtttctgtgcacatgacagtgtgtgtgtgtgcacgtacatactgtatagtcttaaaaatagcattatactggccaggggtggtggctaacgcctgtaatcccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaagaaaaggaaaaaaaaatagcattatacctcttccttgtctcaaccgccatgaaaattctgaacactccaaattcagttgaataatccaaaacaaaatttataagtataaaataattttacttcttatagtaatagtatactttaaaaagcctcagggtatattatcttctaaacagctacaattcagtgcagctacattaaccaactatgttctctagttgagaacaactaggcctatttcactgctgtgtagcctcagtgcctaacatgggtgccaaataaatattcgtagaattacactgaattgtaaaaaccattcgttttggtttacaattgccaaaaatctcaaaaggccctgtatttatgtaattctttgaaattattattttattttgatttctcagttattgactggctgggtgtgacttagtacataagtactcaatattataaaaacctcaaataattgacttgattttacacaacatccttcccttttctacaagttaatttttttacaaatcatttgggttatctcctaaataggttatattttattgcttctagaaacaatgtttcaaaatatatgtgcattatacctcttccttgtctcaaccgccatgaaaattctgaacactccaaattcagttgaataatccaaaacaaaatttataagtataaaataattttacttcttatagaaatagtatactttaaaaagcctcagggtatttatcttctgaccagctacaattcagtacagctacattgagcatctatgtctgatctactcgaggaatactaggcctatttcactgctgtgtagcctcagtgccaaacgtgtgtgccaaataaatattcgtagaattacactg

SEQ ID NO: 362319 - DNA, 3860 bp, Homo sapiens
tcgagggtgcgatggcgcggacgcgggacgcgcgtacgccctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgagtgtctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaaggctttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaaggaccacactgtctctgcttccaggagtattttagaaatgttccacaatttactgaagacatagagatgatgctgctgcttaggtgccttttagcaagctatgcaaacaatgggagaagatgcgccagtcttgctcccatcaggcctgcattcccctacctctgcaggtgctgctctcttcccagggcacaggccacctgaacacacttggttgaccaaaacattttaatgcaactatgacttagtactaatacagagggttggtaccatccaaaaacatacctaaatgtacattgtctaataaactctacccttaaaagcacaatctgatgggagaagactgcg

SEQ ID NO: 362320 - DNA, 3944 bp, Homo sapiens
  misc_feature (3651)..(3651): n is a, c, g, or t
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaanaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctg

SEQ ID NO: 362321 - DNA, 450 bp, Homo sapiens
  misc_feature (368)..(369): n is a, c, g, or t
  misc_feature (378)..(378): n is a, c, g, or t
ggacctgccttctccacccactggtgcctccctgaagttttacgtgccttgcaagcagtgcccccccatgaagaaaggagtcagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggnntcggaaganctggggttattactacaatggaatcgtacaggacggccagtgcgcaagatggcagcacagcagctcggaata

SEQ ID NO: 362322 - DNA, 2936 bp, Homo sapiens
  misc_feature (2643)..(2643): n is a, c, g, or t
tgaggtccctcagttgacttagagtcaattttgtaagtgccccaacagtacagaagaatatacagtaccagtatttttggcaaattaacaagacatccttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcaccccagatgcttgaaatgttgctgctggagctgatgcccacttccagtcattaagcctcctggaagcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaanaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctg

SEQ ID NO: 362323 - DNA, 3559 bp, Homo sapiens
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagca

SEQ ID NO: 362324 - DNA, 3418 bp, Homo sapiens
  misc_feature (3336)..(3337): n is a, c, g, or t
  misc_feature (3346)..(3346): n is a, c, g, or t
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggnntcggaaganctggggttattactacaatggaatcgtacaggacggccagtgcgcaagatggcagcacagcagctcggaata

SEQ ID NO: 362325 - DNA, 1564 bp, Homo sapiens
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatgttttttttttccccatggttgaagattgc

SEQ ID NO: 362326 - DNA, 3905 bp, Homo sapiens
  misc_feature (3612)..(3612): n is a, c, g, or t
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatttcttttaagtgcaaacagttttttattcaacttagaaaagaattgcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactgtgggagaactgaagtccaatcagttcagtatggcaaagaaaaggcaaataaagacagggtatttgcaagatccccaagtaagcccttggcacggaaattaatggattgggaagtagtaagcagaaattcaatatctgatgacaggttagaaacacaaagtcttccatcacgatctccaccgggaactcctaatcatcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactcctaatggtggtattccacatgataatcttgtcctaatcagaatgaaacctgatgaaaatgggaggtttggattcaatgtaaagggaggatatgatcagaagatgcctgtgattgtgtctcgagtagcaccaggaacacctgctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatgctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatcaactgtatcggaaaaaacctggaatgacaatgtcctgtgccaaattacctcagaatatttccaaaaatagatacagagatatttcgccttatgatgccacacgggtcattttaaaaggtaatgaagactacatcaatgcgaactatataaatatggaaattccttcttccagcattataaatcagtacattgcttgtcaagggccattaccacacacttgtacagatttttggcagatgacttgggaacaaggctcctctatggttgtaatgttgaccacacaagttgaacgtggcagagttaaatgtcaccaatattggccagaacccacaggcagttcatcttatggatgctaccaagttacctgccactctgaagaaggaaacactgcctatatcttcaggaagatgaccctatttaaccaagagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaanaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctg

SEQ ID NO: 362327 - DNA, 2242 bp, Homo sapiens
  misc_feature (1949)..(1949): n is a, c, g, or t
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaataaacatgatcaggggcaagtcttgttggatgtcgtcttcaagcatctagatttgactgagcaggactattttggtttacagttggctgatgattccacagataacccaaggtggctggatccaaacaaaccaataaggaagcagctaaagagaggatctccttacagtttgaactttagagtcaaattttttgtaagtgaccccaacaagttacaagaagaatatacaaggtaccagtattttttgcaaattaaacaagacattcttactggaagattaccctgtccttctaatactgctgcccttttagcttcatttgctgttcagtctgaacttggagactacgatcagtcagagaacttgtcaggctacctctcagattattctttcattcctaatcaacctcaagattttgaaaaagaaattgcaaaattacatcagcaacacataggcttatctcctgcagaagcagaatttaattacctaaacacagcacgtaccttagaactctatggagttgaattccactatgcaagggatcagagtaacaatgaaattatgattggagtgatgtcaggaggaattctgatttataagaacagggtacgaatgaatacctttccatggttgaagattgtaaaaatgactttctagattttgtttgtcatgtacgaaacaagagggctggcaaggaagaacccgttgttgtccattgcagtgctggaatcggaagaactggggttcttattactatggaaacagccatgtgtctcattgaatgcaatcagccagtttatccactagatattgtaagaacaatgagagatcagcgagccatgatgatccaaacacctagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaanaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctg

SEQ ID NO: 362328 - DNA, 1162 bp, Homo sapiens
aacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaa

SEQ ID NO: 362329 - DNA, 1309 bp, Homo sapiens
agcctggacaggctttccagatggcagcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagcctgttctgtaatcgataaaccccgatc

SEQ ID NO: 362330 - DNA, 690 bp, Homo sapiens
ggcacgaggctactgcactctgcctgggcaacagagggagactctgtctcaaaaacacaaaaaaggaagatttgggctgggcgcagcggctcacattgtaatcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcatttcgaggcctttcccttgtatgcagggtgccagtgggagctgctatgtctcctgtgcagccagacaccctggacgaggcccttcccacctccccctttcctcacggcttcttcagcaccacatgtggatgcctgtgggtcagtccatctgtccatgggcaggggccgctgtgagagaccccatgcgcgtgggatgtggtagatgctgattatggggccagccacccatacaggtctatcaggtcgcaatggaggccc

SEQ ID NO: 362331 - DNA, 507 bp, Homo sapiens
aagggcacatctaggccccctgagagcacctcctttctgtgtctgttctcaggaatgctgttgagctctcctgttgcaggagcatgagcgccaggggctctggtgtctgaacagcgtgttttgcaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgc

SEQ ID NO: 362332 - DNA, 287 bp, Homo sapiens
acttcagcctggatgatggagaaaaaccctgtctcttaaaaaaaaaaaaaaaggaaaaagaaagatttggacacggacggatacgcgcacaggaagaacaccgtgtaaagactggaattctgctccacgagccaaggcatcaccagaagctgggagaggggcctgcttcagagcctctcttagagccttcagagggagcagacctgctgtcactctgatcatggacttccagcatccagagctgtgtgacaataaatgtctgttatcttaagtggttcaatttgtga

SEQ ID NO: 362333 - DNA, 319 bp, Homo sapiens
cttgccaagttcggaattttagaggatccccccccgaattaaccctcactaaagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362334 - DNA, 5003 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaatgccctaaaagcgcctctttggacactgaggccctctctgcctttcctggcctccggcaacagttttttacaaagattttttgcagtcgaggcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362335 - DNA, 5243 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaatgccctaaaagcgcctctttggacactgaggccctctctgcctttcctggcctccggcaacagttttttacaaagattttttgcagtcgaggcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362336 - DNA, 4487 bp, Homo sapiens
ctccggggctggggggcgggccccgggcccaggcgttgccgactctcgtcgctgtccgcccgggtaaagaggctcctctcccggagggcccgaagcctagcatcgccttcaggcgggaaaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaatgccctaaaagcgcctctttggacactgaggccctctctgcctttcctggcctccggcaacagttttttacaaagattttttgcagtcgaggcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362337 - DNA, 2611 bp, Homo sapiens
tcgacccacgcgtgcggtctataatttctttgaatgtgagacaggggcggaccttgaggacacgctgcatgtactcgtgcaggatgcagacctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaatgccctaaaagcgcctctttggacactgaggccctctctgcctttcctggcctccggcaacagttttttacaaagattttttgcagtcgaggcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362338 - DNA, 980 bp, Homo sapiens
taggcggccatctcatgctaccagtcgaaagcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362339 - DNA, 2311 bp, Homo sapiens
  misc_feature (2298)..(2298): n is a, c, g, or t
  misc_feature (2304)..(2304): n is a, c, g, or t
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcaaaaaaaaaaaaaaaaanaacacncaaacac

SEQ ID NO: 362340 - DNA, 2437 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccaggtattgcagcaccgtgggtgcgccacctcctatcccatgtcccacctcccacgctagagggccggcaaagaagccaagtgcccatagccagagccaggcttcttcctcgcctgagtggattccagagcttctgccctgtccagacgcagctgcaggaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362341 - DNA, 3160 bp, Homo sapiens
agcctggacaggctttccagatggcagcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362342 - DNA, 1197 bp, Homo sapiens
agcctggacaggctttccagatggcagcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaa

SEQ ID NO: 362343 - DNA, 2166 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362344 - DNA, 2012 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362345 - DNA, 2246 bp, Homo sapiens
gcggcagccggaagtcggcggcggtggcggaggcgacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362346 - DNA, 1855 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggaagttgcagtgagccaagatcgtaccattgcgctctagtctgggcgacaagagtgaaactcctcctcaaaaaaagaaaataagagaaaagagaagagaagaggaaagag

SEQ ID NO: 362347 - DNA, 1723 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacaagcacagagcagacaacagagcagagaagaattcacagagcagacagcacagagcagacagcgcgatccttaga

SEQ ID NO: 362348 - DNA, 2719 bp, Homo sapiens
agcctggacaggctttccagatggcagcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaaggactccttctctgctgcctggtggccgctgggcgggcggcccctggtgtggccctgcgcctctgtggcttggtctcagctgttgccctggcattgtccctgagcccagctgtgtgtgctggccaccacacgttcagcctaaggcggactggcagccgtcctgcctgcactttccctgtcttttccctttcccccgctgtcacccctgtctccgtccagcccttgtccctgtggcaggaggaaaggccctcctcctcgaacagccagcagaatcctgctgctccctgtttctggaggtgtgcgtcttcgcgggagggaggctctcgctgcgtggctttgag

SEQ ID NO: 362349 - DNA, 1378 bp, Homo sapiens
agcctggacaggctttccagatggcagcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggtgacgcatgcctgtaatcccagctgctctggaggctgaggtgggagaatcgctcgagtgagttcactgcactccagcctgggtgacagagccagactctctcaaaaacaatac

SEQ ID NO: 362350 - DNA, 841 bp, Homo sapiens
acagtgtcatctcacccgcgtcgcagcatgttatagaaagcctgttcccgaagtgagggtgtgtccggtgggctctggctataggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362351 - DNA, 766 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacaggaagaacaccgtgtaaagactggaattctgctccacgagccaaggcatcaccagaagctgggagaggggcctgcttcagagcctctcttagagccttcagagggagcagacctgctgtcactctgatcatggacttccagcatccagagctgtgtgacaataaatgtctgttatcttaagtggttcaatttgtga

SEQ ID NO: 362352 - DNA, 617 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggtaaccccctcgctctgcatctgctgcgccctgcagggtcctgggtgcccagccagttctcatgccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgactctccctcttccctccaggtgaggcaaacttcataggaatctgtacctgaatgtgagctcctgataataaaactctgaggctttggtgagcgca

SEQ ID NO: 362353 - DNA, 387 bp, Homo sapiens
ctacagcctgcagtcctgagcgtgaggtgctatacttcccaggagacatcggacaagagtgtgattgagctgcagcagtatgccaagaagaacaagcccaacctgcacatcctcagcaagctccaagaggagatgaagaggctagctgaggaaagggtgagtgccaccctagcgggagggctgccgggccacggccattcctgtggcacctgtggagggacagcagaccccaggacccgtgcctgagctgacaccttggaaatgcttggatcctccttccaaaatcagatacaggcttttctttgagcttcgacatgtgtgatagttttataaatcacttcagttttggttctgttgttagagagctggcaggccagcctgttggtg

SEQ ID NO: 362354 - DNA, 471 bp, Homo sapiens
gaaacagggctgtgagatcaccgggcagtgtcggggaggacgccctatggctgtagtctgacattctctccccttggcctgcagcacagcaaagggagacgtcatttgctactatgggaaccgaggggagcctgatcctatcgttttgacgccaggtgagcctgccctggcagcctgatggggtgggggactgtttctatgcagaggtcacccttgtgctttttagagaccaggcacttgtcatattactcttctgagatgactttgtggccatttaagtgccttatggtctgtgggcaccttgccctgcacctggacacttcagagagccctggctccctgctcaccccctccccatgggcttttcctgctgagcaaggtgcgcccctgttctgggcttcccaccgcagccctgcagcccagccggccacccccagcctcacttcctgtgccgtcccagtgtgccctgtg

SEQ ID NO: 362355 - DNA, 1365 bp, Homo sapiens
ctccggggctggggggcgggccccgggcccaggcgttgccgactctcgtcgctgtccgcccgggtaaagaggctcctctcccggagggcccgaagcctagcatcgccttcaggcgggaaaggtgtggacagggccagtgctcgcctgggaccctgccggctttaacacagtttgggaaatccaagaagtcgcctaagtctttttgtccacagaatgctcacgggttgagtgtcacgtagataattgggatacggttttattgtaacaatgagcatggcggaaataaatggaaggtggcaacctgttgacagtgatgcctgtctggtgtcaaccgatggacttgggtttcttgtggcaggagtctgatttgcctttttgcatgcttgcatgtaccttgttcctgcacggcagtcctgtctttggctgtcgactgttcgaggccaaccaccaggcgaggatccactgtttcctggccagactagactcccagctgtgggagtggcccaaaccctgctgcaggccttcactcacaaaagggagtgaatggccagcccggggtacccagtgttgcctctaagtgcgggatatgaggcctgttggaggatgacaaaaggaacggatgaggtcatactgccgctgggttgggcgggaggctgcagcgggagagacttgaccaaaaggcagcctccatggcgctggcactggtgctggcccgtcacagccagtgcctctgttagccaacacagcaagtgggctaggaggaagggtgctgtccaagtgtacgggttttctccccgtgccaagggtccaggggagcttgccgtgagcccgttcctgtccgatagtcctgttggcaaggcagggtttgcatgcggtgtttggtcagctggagcagtggggaggcctacgggcagagagctcccctttgagccctttgcggccaggcgctgtgtggagcacttcccaggggttgttttgtagtctcaccgtgaccttggggtaggaaatgtgcttctggctggcttgcccagtcttagactctcttgttgtagccctctcctttgtgatgtcacccagcctcctgactttaatgccagctttccttgacatcttcacagctccagccctggcctctcttctgatttccagcctggtgtttctggccacctcttccatatctccatgtgttactttggcgccaagtagccatatccaaaccaaactcaaatcttcacccatgccaaaacattccttggcctatctaaagtccctttgattcctctctttcttacaccttcatgcagtcctaaggagccccgtcagctcacctatttctaagcacagaccatttctcaccaccttcaa

SEQ ID NO: 362356 - DNA, 4467 bp, Homo sapiens
agcctggacaggctttccagatggcagcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaatgccctaaaagcgcctctttggacactgaggccctctctgcctttcctggcctccggcaacagttttttacaaagattttttgcagtcgaggcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362357 - DNA, 4432 bp, Homo sapiens
aacttggtaccagggaattggaaggtttctgtcattttgtgacgatatttttaaatttctttgcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacggaaacacgaccctcctctgagtagcatcccttgtctgcattataagaaaatgaaggacaacgaggaacgggagcaaagcagtgacctcacccctagtggggatgtgtcccccgtcaagcccctgagccgatctgcagagctggagtttcccctggatgagcctgactctatgggtgctgacccggggcccccggacgagaaagacccactaggggctgaggcagcccctggggccctggggcaggtgaaggccaaagtcgaggtgtgcaaagatgaatccgttgatctcgaggaatttcgaagctacctggagaagcgttttgactttgagcaagttactgtgaaaaaattcaggacttgggctgagcggcggcaattcaatcgggaaatgaagcggaagcaggcggagtccgagaggcccatcttgccagccaatcagaagctcattactttatcagtgcaagatgcacccacaaagaaagagtttgttattaaccccaacgggaaatccgaggtctgcatcctgcacgagtacatgcagcgtgtcctcaaggtccgccctgtctataatttctttgaatgtgagaacccaagtgagccttttggtgcctcggtgaccattgatggtgtgacttacggatctggaactgcaagcagcaaaaaacttgcgaagaataaagctgcccgagctacactggaaatcctcatccctgactttgttaaacagacctctgaagagaagcccaaagacagtgaagaactcgagtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaatgccctaaaagcgcctctttggacactgaggccctctctgcctttcctggcctccggcaacagttttttacaaagattttttgcagtcgaggcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362358 - DNA, 2394 bp, Homo sapiens
agcggagttgtctctgccgctggggaaggtaaagcggcgacggcgtcctcaggagctgtggggtcccctgctagaagtgggggactcggcgggtattttaaccacatcagcatcgaggactcgcgggtctacgagctgaccagcaaggctgggctgttgtctccatatcagatcctccacgagtgccttaaaagaaaccatgggatgggtgacacgtctatcaagtttgaagtggttcctgggaaaaaccagaagagtgaatacgtcatggcgtgtggcaagcacacagtgcgcgggtggtgtaagaacaagagagttggaaagcagttagcctcacagaagatccttcagctgctgcacccacatgtcaagaactgggggtctttactgcgcatgtatggccgtgagagcagcaagatggtcaagcaggagacatcggacaagagtgtgattgagctgcagcagtatgccaagaagaacaagcccaacctgcacatcctcagcaagctccaagaggagatgaagaggctagctgaggaaagggaggagactcgaaagaagcccaagatgtccattgtggcgtccgcccagcctggcggtgagcccctgtgcaccgtggacgtgtgagggaggtggcacgggccagggcgcgggggccgccagccgcacttctgaggagaccagcagtcatgcatcgtgcaccacagtgtcaggcctccaacccacgctccttccctgtggccaacctgtgggcccggccttagggtggaggctttagtgtacagggacagccatggccacacagcacacatgtggagcagcggctctccctggaaagctccaggcctgaatggatggactcagcgactgcaccagtggcagctggtgactgtggacagtggtggaccctgcttctgtgcacctgctgcaggctctttttatgaaggctttcatgaattttagtatgtaatacgcactgacgacacatgatgcttggatgacagatgagaggggatggctgagtcctgtggctggcccgtgatgccaggtggcccatgtgcccagggcgcctgcagggctgctacagggacctggtcaggaggtgcacatggtgccctgccctcacccaccctctgtgtttccccttctttgaaaaggtagaagagaaaggaatattttaaacctttttggcttaaacagaattttagcatcagaactagctttctgggattggaggcaaaccatcaaggtggtccctctccagtctggacacgatgccagcaaggatgacgtcctgccacctcctggagttaccctggcctcctagggtccctttttctgatgaagtcttaatgccctaaaagcgcctctttggacactgaggccctctctgcctttcctggcctccggcaacagttttttacaaagattttttgcagtcgaggcacatatatccacacattgatttttaaagcttttgtgatattttagcattttgaaagactttcacagtgagagtagaaggtagatttggaatcatgcattttagcaagtggacttgttgaaacaggaagcaagggccttcagtgtagcccattcttgatccagagctgttgcctgtgacagcggtttctctggatgtcaaaggcagctgcctggtgcccagcttgcttctcgactggtggcccctatgggtgggtgtgcgatggaaatgtgttcctgccggagtctgaggcaccagggtgtgctcaaaggctggccctggtggtggactggcacctgtgcagagtgccgtgtgcttgtggtgcgccatctgaagcaagagtccagcgttctgccgtgtctgtcccccaccatgccccctacaggcggtactgatggcgcttttttttttttttctgtcaggaaaacaatgttggcctgtgggccgcccacaacatatccttccctcactacctgtgtgaccaaggttggcttctgttgacctttaaaaaagaaaccctcaactcaaattgctataattagacacttgcttctgtcttgcctcctgtctgcagctgtgaatagtcatttgactgtgactgttgcccttagccagccagatgcgcctgtgaaccaaagcttcgtgcacatgtgttcccctaaaggttggggagcctcgctgtgtcttgctgttcccaggcaccaccacagcaggtgctgccatactcttgtggtctctgtgcgccccccccccccccacccgtctgccaagcatgggtatgaatcgtgcacacagccatgcttcaaggccggggcaggggagcctgtgctgatgccatccagggcactgggctgtgcctggaaggcgagccttgattgtctgaacacataaagcaaactgtccagaaaaaa

SEQ ID NO: 362359 - DNA, 2281 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362360 - DNA, 2539 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgcatttcgaggcctttcccttgtatgcagggtgccagtgggagctgctatgtctcctgtgcagccagacaccctggacgaggcccttcccacctccccctttcctcacggcttcttcagcaccacatgtggatgcctgtgggtcagtccatctgtccatgggcaggggccgctgtgagagaccccatgcgcgtgggatgtggtagatgctgattatggggccagccacccatacaggtctatcaggtcgcaatggaggccc

SEQ ID NO: 362361 - DNA, 2095 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362362 - DNA, 2056 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgaggcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362363 - DNA, 1910 bp, Homo sapiens
cccggaaacaaaaaatagctaggtacgggcgggtgtgtatcggccgaggcgaggccggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgccccagcctcctgattagctgggattacaggcgtgtgccaccatgcccagctaatttttgtgtttttagtagagacggggtttcaccatgttggtcaggctggtcttgaactcctgacgtggtgatccacctgcctcggcctcccaaagtgctgggattacaggcgtgagccaccacgcctggccgaaaaacccactctcataacagaagtgcagactcattgctagattcagtgcccttgagtgtgccagaggtcctctgtgtttgagacaatcctgtgtgtgccaggaggctccgtgtgcaccaggggctctcagaatcccgcttacccagctggagaccatgcctctggcagccccatctcagccagccctgctctctccctcttccctccaggtgaggcaaacttcataggaatctgtacctgaatgtgagctcctgataataaaactctgaggctttggtgagcgca

SEQ ID NO: 362364 - DNA, 2015 bp, Homo sapiens
  misc_feature (1976)..(1976): n is a, c, g, or t
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctcttttttttttttttgagacggagtcttgctctgtcacccaggctggagtgcagtggcacgatctcggctcactgcaacctccgcctcccaagttcaagcaattctcctgtaatcccagctgacggctggagccccgatgctagctacaatggctggcttgagtggacttctgtcaggagaattgcttgaactcgggaggtggaagttgcagtgagccaagatcgtaccattgcgctctagtctgggcgacaagagtgaaactcctcctcaaaaaangaaaataagagaaaagagaagagaagaggaaaaaaaaaa

SEQ ID NO: 362365 - DNA, 1267 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcatcgccagcctcctggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagaggaggggttagctttacagcgtgaacttataacgtttgctctccacaggggctgaggttcttgatcatcatgctaggc

SEQ ID NO: 362366 - DNA, 1479 bp, Homo sapiens
agcctggacaggctttccagatggcagcggcggtcggtcggtgaggctttcccggctgtggtttggctgcgggcggcttgggcagcccgcgggcgcctcaggtagaagaagaaaggtgccactccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggatgactttgacaacgatgtggatgctctgctggaagaaggcctttgtgcccccaaaaagaggcgaacagaggaaaaatatggcggagacagcgaccatccgtccgatggagagacaagtgtgcagccgatgatgaccaagattaaaacagtgctcaaaagtcgtggccgcccacctacagagccgctgcccgacgggtggatcatgacattccataactctggagtcccggtgtacctacacagagagtctcgggtggtcacctggtccaggccatacttcttgggaacgggaagcatacgggtaggggaggcatcagtcgtgactttaggcttgtaagttctcagaccaaaacgtgcacatccacacacatggcaccgc

SEQ ID NO: 362367 - DNA, 576 bp, Homo sapiens
gcggcagccggaagtcggcggcggtggcggaggcggtgagtgcgcggctccggggctggccgactccgctagtggcccggccggcctgggctcgggggctccgggctctgggctctgggtgcgcggaccgggccaggctgcttgaagacctcgcgacctgtgtcagcagagccgccctgcaccaccatgtgcatcatcttctttaagtttgatcctcgccctgtttccaaaaacgcgtacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgagcacagcaaagggagacgtcatttgctactatgggaaccgaggggagcctgatcctatcgttttgacgccaggtggccccccaacctggcgtgaggtgaagaggttccctcttggctgtccccttt

SEQ ID NO: 362368 - DNA, 295 bp, Homo sapiens
aggaagctgtgctttgggaagcagctcttcctggaggctgtggaacggagccaggcgctgcccaaggatgtgctcatcgccagcctcctggatgtgctcaacaatgaagaggcgtgagtgggcgggtcctgctggggtgagccccagtgtcccgccaccagggcagagggaaaggcaggccctgctgccccgggaggcccatggaagtggccaggctgggtccccagctgcagggaagctgatggatatcctgtcctccctgcctgtccccttgagccagctgaggtttccaaca

SEQ ID NO: 362369 - DNA, 1019 bp, Homo sapiens
  misc_feature (265)..(265): n is a, c, g, or t
  misc_feature (421)..(421): n is a, c, g, or t
  misc_feature (898)..(898): n is a, c, g, or t
  misc_feature (924)..(924): n is a, c, g, or t
  misc_feature (937)..(937): n is a, c, g, or t
  misc_feature (945)..(945): n is a, c, g, or t
  misc_feature (991)..(991): n is a, c, g, or t
gatcgcccccagctggtggggctcgcggactcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcntccgctgcgctgtagcctggaggctccgggcgcggggaagtcatgctcgcttcacggaggcaatagctagccggtgtctgtgggaggttatgtttatttgagagttctccatcgggatcgcctggtgtcaccaagtgtccactggtactgaggttngctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggcagcatcagttttttccataaaaccgggcaacangctgaaccattagttgttgatcttanagacctttttcangttatctntaatgtaaagaaaaaggaagaagaaaagaaaaagatagaggaagcnagcaaagcagttgagaatgggagtgagg

SEQ ID NO: 362370 - DNA, 531 bp, Homo sapiens
ttgtggtgtgattaaaatattactttaaagtatgtgtgtgtgtgtgtgtgtgtgtgtgtatttatgttgaaaatagtaccactgtcagtataaagatatggttataagaatgtttatcaaagtgtggtttgtaagaataaaagctgcaaacaatctaaatatctaatagtagaaaatagcttaaataatagtatgaccatatactacaacattatgcagccattaaaaattatattgtaggccggacacggtgactcacgcctgtaatcctagcactttgggaggccgaggcgggcagatcacgaggtcaagagattgagatcatcctggccaacatggtgaaaccccgtctctactaaaaatacaaaaattagctgggtgtggtggtgtgcacctgtagtcccagctactcaggagactgaggcaggagaatcggttgaacccgggaggcagaggttgcagtgagccgagatctcgccattgcactccagcctgatgactgagtgaaaccccatctcaaaaaaaaaaaaa

SEQ ID NO: 362371 - DNA, 350 bp, Homo sapiens
ataattatttaaatttatctacatgtacttagcagctaggacttagaaaatacacttgcaaatattcttttctgtggcacatttgtacatggagatgatggggtatgattcatgaaatgttttaaaaatgaaaatgtaacatactgtggcaaaggttctactttcttggttccaatttaagtctcttgaaagcaaatcctattttcttattattgtccatatatttactgtcagagattttgaaattttgaagaattagaagcatcaataacttagagtgctgttagacacttacttttttcctggagtaatcatcctgcctctgaaaccttccttttgtctttagcatt

SEQ ID NO: 362372 - DNA, 329 bp, Homo sapiens
atacagatgtggtcctttacacaggaggtcatatgccctaacggttttcttagctgcaggctgtgctgatattccatctttgcccaagtcctcttgcctttctctgacccctaccccaagcacagcgatggtgaccggccttttcctcccgcctcccagtttcctggagctggaaagccctgggctcagtaaggtcctccgcacaggagccttcgcctatccattcctgttcgacaacctcccactcttttatcggtgtgtaaaggaccgcatctgtatgtggggataaagggtctgacagaggaagtcctcagtacatggtcccgatg

SEQ ID NO: 362373 - DNA, 2049 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362374 - DNA, 1838 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362375 - DNA, 1952 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362376 - DNA, 1787 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362377 - DNA, 1674 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362378 - DNA, 1953 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgcacagcgatggtgaccggccttttcctcccgcctcccagtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362379 - DNA, 1817 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362380 - DNA, 1614 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362381 - DNA, 1150 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362382 - DNA, 376 bp, Homo sapiens
cacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagcactttctagaactgaagaaggtaaaacctcctcacccccatcctcctgacacctccctcccacactccataaactggacagactcacaggcccac

SEQ ID NO: 362383 - DNA, 952 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggcacagccaacagttaattcacatctg

SEQ ID NO: 362384 - DNA, 1914 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362385 - DNA, 2091 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362386 - DNA, 1922 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362387 - DNA, 1984 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagcaaaaaaaaaaaagaaagggatacagataaaagaacaaagaagaaaacaagggggaggccatagaaagaacc

SEQ ID NO: 362388 - DNA, 1846 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtgttctgggaagatggcatcatgtctggctaccgccgccccaccagctcggctttggactgtgtcctcagctccttccagatgaccaacgagacggtcaacatctggactcacttcctgcccacctggtgaggggaggctccgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362389 - DNA, 1980 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacattttttaaaatttaaattttggcaaaaagtatttctaaaaacttgtagggggggcccgtttccaaaattggacgtttgggtagatctctttcc

SEQ ID NO: 362390 - DNA, 1226 bp, Homo sapiens
agcggactccccgcccaggcctggcccgcctgcctagcggactcttcctccatcagcctggctggcagcagccttggactccgcccgtggagccctgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagca

SEQ ID NO: 362391 - DNA, 518 bp, Homo sapiens
agaaaggggaaaaggaggaggcagcctgctctgtgagagagcaggcccttaatgctttgttggttttccttggaggcaagagttcttttgggatctgttctgaaggccatttgtttagctcatctgaaaacatggtgttctaagcaggcttgacaacactggcttgaacctgaaatatgtttcttttcatattggccctatgtcctctttgtgggacatatatgtcagctcagctggtgggcaaaagttaggactggtaatgaccctaattaatgtggtataccctgccaatgagagaacgctctgggaatgtgagaggcatgtagatcatggggcaatatccaacattctcctctttgctctgtcctgtgtcctatccagcttcaaaaccctatacaaaagtttcagactgatggcccaatgagtgattggcataatgtttttaaaacatctaaatgtgaatgcctttaggaggattatgtactctagttttccatagcccccactacccactatca

SEQ ID NO: 362392 - DNA, 450 bp, Homo sapiens
gacaccaaatctgctagcacctagatcttgaacttccaagcctccagaactgtgagcaatacatatcttttgtacataaattacccagtctaaggtattttgttatagcaacccaaacagactatacaatcacttaagttttatatgtcaactgcattaggcatagtacttctccatagtaaaacctaaatttatactgagagtgttgatataaagacatccagttaagtatggtaactgaacatactgatttacttcaactccttccccaaaatcctgctaaagtacagtaagaattttaaaaaggcttaacctccaaagagagaagggcaatagaaaataagagacagcaataaaattttggaaatagaaagtagatgaaagagtcataactgactcaaaagatctgagaaatcagtaagaagcacatcaattccctccaaataacta

SEQ ID NO: 362393 - DNA, 1266 bp, Homo sapiens
aggctcagcaggcgactcctcggcgccatcgctgtcgctggaatcagccgcgcgctgccgaaaagtccttttcggcctgtgagccatggccgaggcccgagcgcccggcgccctagaacccgctgaaccgcaagccgcagcttcagtgcccgccccctagggcgcgctcccgccgcgcctggccgccgagtgcgcgcgcccgtcccgcctgccttctgctcaccgctactctgtctgcgcctgcgtgctttggctccctggatctgatggagtcttgctctgttgcccaggctggagtgcagtggcatgatctcagctcactgcaacctctgcctcccagggttcaagcgattctcctgtctcagcctcctgagtagctgggattaggtgtgcaccaccatgcctggctaagttttgtatttttagtagagatggggtttcaccatgttggttaggctggtctcaaactcctgacctcaggagatccacctgcctcagccttccaaagtgctgggattacaggtgtgagccaccacgctcagctgacatttggttatatttgatttttttgttatattacaaataatgttattaaagcacttgtgatacaagtgtctctttgggtcatgggcacacaattcagttgggtataaacctaagaatggaatcattaggtcatagggtaagcatatcttcaacttcactggaaaatatcagttcccaaagtagtaattgcctaaatttacattctcatcagcagtgtattaaagtttccatggctcctcatacttgctaacacttggtattgtcagctgtctttgttttagccatctgggtgtatgtccttattctttgaatacgaatttccttgattactaatgaggataaaccctttttcattacatatatgtgaatacacatatacataaatatatacagtatacatactgtatatgtgtatatgaaaacatatatatacataaatatatatgtatatatactgtacatattaggctatctggagttcttcttttctgaattgcctgttcaagtctcttgctcatttttctattgagttgtctgttttttcttaatggtgcatagctctcctgtatgtattttgtatttaactgatagctgttttgcaaatatattctcccagttgtggtttgctttttcactctattaatgattgtttttggtaaagagaaattcttaaatgtttaatgctaatataataaaatctatttaacctttctttaccat

SEQ ID NO: 362394 - DNA, 661 bp, Homo sapiens
atccattagggagaacctgaaaggtccttttttggccctccaaggtgaatgcctgcaaaagcaagcgaagcacgctatctgcctgcatgagccccatgtacctggcgtggcctgtgctcctcaccgtgtgtcccacttctgctgccccttcgccttgccaggtggagtctgactgattttttgccactgctgccaccacaggccacctggagccccagccagtttgaggaaagtggctctgcttgattttccttttttcttttttttcctctttttttctccatttctgacttcagcaggtgggacttggagcttctgcttctgcagccacagaagactccccagtttggagggctgtggttgtgggctccctaagcatctctctgcagagcctctttgttttccattttacccaccatgtcaataatttaacacagtggcggaggagttcatgtctcttcctatttgtcattactcttctaactttcacagctgtactcggctactggtcagaataagagaaaaagcagtggaaccaggaggatcctacaagaaatattccatttcacttttgtttgtgcatataccttttctgtttaaatgtggacttcgatttgatatgcttccagtgcagacacagatcccatatgtaagagagtat

SEQ ID NO: 362395 - DNA, 300 bp, Homo sapiens
gttaaatgattgttatattgttttaggattatctatgatacactttgacatctcacacacacacatgaacttttctttttacaatgcaaaagtttaaacaatagcttaaatttagactgcaagaatattataatctcaatatggtatttggtactagagatagatttcttttataaaatcttaaaaacaggacgttctcttccttttgaacctttatcccagaggtgaaaatatccaatatgttgttttctgcatatattgaagtagtagtttcactttaataaagatggattaaaagtt

SEQ ID NO: 362396 - DNA, 524 bp, Homo sapiens
cttagttttacttcaaaatccattataaatatgtgcacttctctcaaaatccattgctactgttctagtctgaccaccatcatctcttgactggtccatatcaataggcttctaactggtccctttgcctccatttttgcccatctcaaattcattctacacagaatagccaaaattatttttattaatttattttaaaaatcagattatgctacttacctgcataaatttccaatggctttgtacgcttaaaatccaagcttcttatcatgactttcatcacccaacatagtgcagctcctgtctaactctgtggctttttaaaattctatttatatcagtcagggttccctcagagaagcagaaccaataggcaggacatagactttaaaagatttattgtaaggccaggtgctgtggctcttgcctgtaatcccaatactttgggaggccaaggtaggtagattgcttgagctcaggagtttgaaatcagcctgggcaacttggagaaaccctgtctctac

SEQ ID NO: 362397 - DNA, 1867 bp, Homo sapiens
gtagatagtcagatgtcttttgaaaatgtgttttcggtgtggaatattaacccaatctttgataactcttccagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagc

SEQ ID NO: 362398 - DNA, 3279 bp, Homo sapiens
gcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataaaaaaaaa

SEQ ID NO: 362399 - DNA, 3225 bp, Homo sapiens
gcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataatcatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataaaaaaaaa

SEQ ID NO: 362400 - DNA, 3423 bp, Homo sapiens
gcgtgcggatgcggggaggctgcgtgtgtgcgcagggagagaacgccggccaccttcccgcttccgagctgggtgcgcgccgagcacaggagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaatattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataaaaaaaaa

SEQ ID NO: 362401 - DNA, 3624 bp, Homo sapiens
acacattaccacgcatttccggaagaacatgggagcttgccgcgccgagcacaggagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagactaaaatgttcgttcaaatgaatggccattggataactccagacctgaaaataaacactgttgtcaaaacagcatccaggccgggcgcggtggctcacgccagtaattccagcactttgggaggccgaggcgggcagatcacctcagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataaaaaaaaa

SEQ ID NO: 362402 - DNA, 3219 bp, Homo sapiens
gcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaatattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataaaaaaaaa

SEQ ID NO: 362403 - DNA, 3385 bp, Homo sapiens
tgggtctcgggtctcggtgacgagcagctgcccgcctccggtgagcgcgggagaaggggcccagtggggcagtgggcgacgcggagggcccaggcccaggccgcggccgcgccgcatccgctggttgtccaccttgccttgccccagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaatattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataaaaaaaaa

SEQ ID NO: 362404 - DNA, 2532 bp, Homo sapiens
gcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttagagtcaaaaacaaaaaaaaaaaaaacaaaaacaacaaaacacaacacacacacacaccaacaaagccagcagacccacacacgaagcaaagacgacgggcggacaacgcacggtcccaactgcagaaacagaaaaacaacacaaacgacaaaaccacggaaaacagacgaagcagagaacaaaagagacacaccgagcgaaaaaccgaaaaaagagcagaaacaccaacacaaagcaaagacagaacagcgcaaagaagaaaaaataggagagacacaaccagaaagaatataaagaaaagaaaaaaagaaaaggagaga

SEQ ID NO: 362405 - DNA, 3604 bp, Homo sapiens
gcgtgcggatgcggggaggctgcgtgtgtgcgcagggagagaacgccggccaccttcccgcttccgagctgggtgcgcgccgagcacaggagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataaaaaaaaa

SEQ ID NO: 362406 - DNA, 735 bp, Homo sapiens
ggcaagtcagaaagagaacatggtcacccagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362407 - DNA, 517 bp, Homo sapiens
ttcattgccccttcaatgtgggaatccagccagaccctattcttggacagcatcagtgaaaggggcttgggaaagctcttgggcgtagcagcagaggcatgtcatatatggaaaccttccatgagggtgacctcaccactggaacccgttcaacataaaccttgctgcaagaactagcagagctctttggacaaaacgtgctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaataagaaagaatcgtccgtt

SEQ ID NO: 362408 - DNA, 482 bp, Homo sapiens
agcattcatttccaaagaagaatggtggtggcagaatggggaagtagatgctgggcaggcaaaggcaacagatgtccaccatgcatgcctagaagaaaaaagtgctgttagctttagataatagcagctggacgatggggtagtgaccttctcactcccaaaaagctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaataagaaagaatcgtccgtt

SEQ ID NO: 362409 - DNA, 954 bp, Homo sapiens
aggagcttccttacttattaggaacctcaggtggacctctcatggttgcagatggcttctcacttacaaaggagattgtgaccagctgttgagaactgtttggctttacttccttcagagaccagacttggttgtatgtcagagtagtcccccccttatcctcaggggatatgagcccagaccccccaatggatgcctgaaatcacagatagtaccaaaccctatatatgctatgtttttttcctatacatgcatacttgcgataaagtttaatttataaattaggcacaggaagagattaacaacaactataataaaacagaacagttataaaaatacagtgtaataaaagttatgtggaagatgatctctctttctccaaagtatgttattcgtatgtaatattttcagattgccagttggatatgggatagctttaaacctccggaaagggaatcgcaaataaggagggattaccatatatcctcgctaagagtcctctgactctttttctctcctcagactcaccccacacagaccgcgtttctctccagtgtcgacctacacactcactgctcttaccagatgatgttgccagagtcagtagccattgtttgctcccccaagttccaggagtgagtatagagggcatggttctgggtgtttcaagggggtagtagggaagaaagcctcaggggaaaaggtctctattcttgtggacttgtcctttgtaaaatacatagattataatgtaagttggttattctaaagggcttccttttaagccccatatcatgatttatctatcatgcttgttcaaaaagatatccaagtaacaacttagttgcttttctaagaaaagtctacaagaaatttgaagtgtttgacttgaagcgataggaatgtcaagagttttatgttggattagaaagtttcaaaatcataaaatataaa

SEQ ID NO: 362410 - DNA, 384 bp, Homo sapiens
tcccatagaaatgatggaatctcactaaagcacaagatatggtaaatgtaattctactggaactgtgctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaataagaaagaatcgtccgtt

SEQ ID NO: 362411 - DNA, 358 bp, Homo sapiens
tcccatagaaatgatggaatctcactaaagcacaagatatgctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaataagaaagaatcgtccgtt

SEQ ID NO: 362412 - DNA, 2088 bp, Homo sapiens
ggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362413 - DNA, 2012 bp, Homo sapiens
gtgagcgggtttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtcctgtacttcaataagagatttgaaggcaaaggaaaagagaagccacttcagatagagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362414 - DNA, 2236 bp, Homo sapiens
ggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaaggtgggtcttcactttcattgttgcccatctaaaagcttcagagcagcacagactgacttcaagataaaagtagtagtctctgcatctgagtaccagatcctgcaataggagataaggccatttcaccacaacagttctgaagtagcagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362415 - DNA, 1844 bp, Homo sapiens
ccatctgttttttctgtctcagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362416 - DNA, 1417 bp, Homo sapiens
aggagcttccttacttattaggaacctcaggtggacctctcatggttgcagatggcttctcacttacaaaggagattgtgaccagctgttgagaactgtttggctttacttccttcagagaccagacttggttgtatgtcagagtagtcccccccttatcctcaggggatatgagcccagaccccccaatggatgcctgaaatcacagatagtaccaaaccctatatatgctatgtttttttcctatacatgcatacttgcgataaagtttaatttataaattaggcacaggaagagattaacaacaactataataaaacagaacagttataaaaatacagtgtaataaaagttatgtggaagatgatctctctttctccaaagtatgttattcgtatgtaatattttcagattgccagttggatatgggatagctttaaacctccggaaagggaatcgcaaataaggagggattaccatatatcctcgctaagagtcctctgactctttttctctcctcagactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362417 - DNA, 3298 bp, Homo sapiens
ggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaacttaaaaaaaaaaaaaaaaaaaaaaaaaaaaaaaaaaaaaaaaaaaaaaaaaaaaaaaaaaaaaaaaaaaaaaaaaaacacacaaacacaacaaaaacaaaaaacaaccacaacagcaaaaacaaacaaaaaacgaaaaagcaagaccacacgcagccgaaacaaaacaccagacaccggcaccccgagcagacacaggcaacacccccgcaccagagcaccacaacacaccgagagacgagacacaccagtggtggccacagcactcccagccacgacagccagtccgcgacccaccaggggacgacgagagccgcaccacaagagcaaaaagtgcgccacacagaaaagagacaaagacaacacccagccaacaagccacgcatccgcggacaaaaccaccacaacacccgcacacgagcacacaccacacacccgaccaagacggaggggaggacgggcgaaggtcgcaaggagaagaagaactaggagtgggcagagaggcagagacaaacgcaaaacgaggggggccgaagagaacgagagggagcacgagaaagaagagcggagggaagggagcgagagagaagggggcgagtgaggggcgacgaagtagagagacgggagagaagaagagaaaaagggaagaagagggcggaagggtgaaagacacagagaaagcggggaccgaaccagcacaagagaggaagcggaaggaggggcagcggggagaagagcacaggagaccaacgaaagaacaagggacggaggaagacgacgcaaaggaggacggaggaagaaggccgacagcagagaggaagcgggagcgtagaggagcgcaaagaggggaagacggagggaggaggggaagggaaggacgcaagaagaaagaaaacgaagcacagagagagggacaagggcaggaggggcgaccggggcaaagagggaagagagagaggggaaagagggcggaagcagcgagggaggggcgaagagggcaagaggcgggggggagaccggacagccgagcgagagggaagagaaggagaacgagaagaggacgcaagactacagacggagacgaaagaagcgagagcaaaggacgagacgatcagaagacgacgacggagagagggggcgacacagaaactgagaggagagggcgagtaggaatgaggacagcaaacagagcacacagacaacacgcaggcccg

SEQ ID NO: 362418 - DNA, 4403 bp, Homo sapiens
  misc_feature (173)..(173): n is a, c, g, or t
  misc_feature (548)..(548): n is a, c, g, or t
  misc_feature (1258)..(1258): n is a, c, g, or t
tcttttggtgctgtctcaaatgggtcaaccattcacttcctccttatgccctccatgcttttggctgaggataatgaagcctttgtttggagtaccaggttacactccaataaatgattacatttcccagccaccccaccctaccaatttcattgtgttggctgttcttttcngactaaggcaatacctaggaaaacgcttgaagcagcaattgttactgcaattttctgtgagctgagcctggtgttctaggtggcctagaaataatggtgtcatttgtgacacctcgagtgagggcaggagagtaaatactttggctaggagaagagtgatttattctttatcagaattctaggtgggggagggagaatctgtgaatgcataaagttttcttcatttttaaattttgtctcagtctttattgcttaggttagtggtccttgaacttgtcccctgaaagagcccagttctctatattctttttcttctcttgggttcttaattccccatatagtggaaattccttctttgctgttttggtatgggtnggtctgggggccagctgggcttggacaagccatttcctgctgcagcccagagcagcctggctgttccaccttgctctaaacagtcctgaaattgcccagtcctctgcttttgggaaatccatccccttcttcccattctttgtctaccacttagcttagggctttcttaccttttatttcgactgtagccgttggcttttaccaagtctctttgtttttagcatttcttcattccagtctgttctgcacactttgatcaggagaagcttctcacattccagccatgttcatgttttctctcttgctcaaaaacctgcaatagcttcccattgctgaaaatctaaatttagcttttagtcagaactttccacttaaagttcttacccctggctatatattcaaatatctagggagcaatttaaaaaatactgatgcctgtgttctaccccccaccaattaaagctgaatctctagggtggagcctcagatgttgtttctgcatttgtctttcaagctgctagaattctcaagtacaaccagggttgacaaccactgcattggtccttgatacctaagaattgtgagctctcttatccgtctctgcccaccaaagacattcagccaggtcaacaacatatcatacgttgcaaccacattgatcacagactgatcaccaaactgctatattttcttttctcttcctctaggcncaagatatcttagtggctagatgggtgcaggaaatcagtctgtagatccctcttcatatctgctgcagcctagccactgcagaggcactctgcataggatggtctaagtgtctctgtcttcatcttacctctgtggaggagacgtggaatcaagccagcccacaagccctgagactggataggccggagagaaagaggagtagccagagcggtcgggaaaagaggaaaggaatactgtgggtaaaagggacaaagaccacgcaacctgaggaaagacattgtattgaaagggtaatgactatttggctaaagggactgactcctgggttcccgaggctcaaagaccaggagacttttccactcttgcaagctgcacaagtaccatacttagtgttctgggctgagaggggagacaaaagcatcgtcaggttgccaaacaatgtcccagttgccctgggaggcacaaacctaccaaagtgccataggccaggtgcagagagaatcagaggagctgatttgcttggggtcagagcagagctgggttttttcagatgatcactttcacatactccttgttaaatgggaccaaaggggaagaagaagaaacccttaagcttttgtaatattgtcttgggtaccagataccataaaaggcagcatgagagaaacattcccttgggccagtgtcatggtggattttcttgcttgagaggcaaggatttcagctttcatttggtaccacagaatttaaaattgtaagtgcctatcccttttgactgttgatggcttctttggggttttagttaccccagttgaaagagaaatttttcatattggggttgagaagaatggaggctattaggagcaaagctttaatgagtgaaagtctggtgaatcctgcaattttgatatgtttccagtggattttgagaacacagttttaggaccagagtagatgttgttccctagaaaatagagtcagctattgatattgtgcctcccatccctcatatctcagtgttttaaccccacctgagtttggagaccagtttgtccaaggatctttcaaacatgtgagcccagagtagaacttctgagtcaaggatcatgtctttttctgaggagctttgcttggggcactggaaatcctgtttagatcaggactattggaatattatcctctccaggggaagtgccaggttgaacatttaaggctttgcttctaggcccagctatacattcaccagcaaatcacttaacttcctaaatttctttaaaatctgtaaaatgggatcagtctaatatgcctacctcaaatgatgacagaatgacatctatatgcatatgaggcctacgttagttgaaagatgctataaagatataagggatttgttacttgtctttcttgaaatgttacagttggggtgcggttgcttctatcttctggacctctgcccattcagcatacagctagaggaatctttgggcagatccacattctttagcactagctaggctttgactccaaagctatctggtctaccttgatgttctgagcaggaaaactgaggacctcaagaaccattccaaatttctactcattctccctaagacccagagcagacccaggacctaaagaaattacatcatctctattttcccttggctccagcccactcttgtttgaacctcccacttttgttgttccaactacttcttgagatgaaggaagggcagaacattggccctcttcactgaagtcttcaccccttaatccagggttcaatttttagttcaccttagcctgtttgagattagaagctgggccttaacttacaggtgtgtccggcatcattcaatcagcctgttagatccagaatccagcactgtgacgctacataaccatgggctctgtccttccagttcctttagtgccttccctcactggtaggttcactctgagggcttccttccttgaactccagtggcaactatagtctgtttcccacaatttgttgtgtgtgttttttgttgttttgcagcgttttcatattgtcttttatgtaagtcatgtttctgaactatcgtataaatttcattagggtaagaatcatgtttgctttatgcactgtgtaacatgccttgcagtcagtataggcacttaaccttattgatcagttgttccttggtgttgaataatgtgttaggtagccaggtggacctgtgtcctagcctggagaagctctatgtcaccttgtaggaagccatctgaatttgactcagcatcatatgctgggcctgtgctgcacttgagctttctttccagccgccaggagggatggttgtcctggccaacagcgaatttaatgggtggtcaaaagaagatgtgcctgcatagaaggctgaaagagggagctggaagtaggaggagacaaggagatagtgacaccagtatcttgtcacagaaatcaaggaaggcaacagtttaaaggaggggagggagatcagtggtgccaactggctcagaagaggtttgctgggttaaatctcaagatgagcccatgagatctggtggttagcagaggcctttcctgacaaccccattttaagcacctcttccccatcactctatctcatcactgttactgtctgtgtagccctgtcatgagctaaaatcatcctgtttgtttattgctagcttatgtgtctaaagtatactccttgagaacagcaactttgtctttttcacctttgtactgagtcccctgacatggaataagatatgaataaatgcacagacttgtccaaaatcatccaattaataaatgctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaataagaaagaatcgtccgtt

SEQ ID NO: 362419 - DNA, 1493 bp, Homo sapiens
gtgagcgggtttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggagtgagtatagagggcatggttctgggtgtttcaagggggtagtagggaagaaagcctcaggggaaaaggtctctattcttgtggacttgtcctttgtaaaatacatagattataatgtaagttggttattctaaagggcttccttttaagccccatatcatgatttatctatcatgcttgttcaaaaagatatccaagtaacaacttagttgcttttctaagaaaagtctacaagaaatttgaagtgtttgacttgaagcgataggaatgtcaagagttttatgttggattagaaagtttcaaaatcataaaatataaa

SEQ ID NO: 362420 - DNA, 679 bp, Homo sapiens
cgacctcggaccccggaactcttcggatgggagggagatcagtggtgccaactggctcagaagaggtttgctgggttaaatctcaagatgagcccatgagatctggtggttagcagaggcctttcctgacaaccccattttaagcacctcttccccatcactctatctcatcactgttactgtctgtgtagccctgtcatgagctaaaatcatcctgtttgtttattgctagcttatgtgtctaaagtatactccttgagaacagcaactttgtctttttcacctttgtactgagtcccctgacatggaataagatatgaataaatgcacagacttgtccaaaatcatccaattaataaatgctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaataagaaagaatcgtccgtt

SEQ ID NO: 362421 - DNA, 460 bp, Homo sapiens
aacacgaatcccaaaggaaaaaagccaaagttaaaggttacataagagctagaaggagtaaggaaacatggttttctcttgcttcctgcccatggctgccaaacggttctctgaagactgctatgtgacagaagccctttcctttgaaaacctgtcacgtcacaacaagaaaaagatctctttctttggaggtacatttttgggcacaagaaaggctttttaaaatttttttggccatctttttcattgtaggagtctggtgcttgctgcctagtttgggagtagaggaaaagactctggctctttagggggatagagatgggaaaggagcatggcccagctgggtgtattagctctccctccgctgcacttctggaacctttcatataagggcttcaggataagggggttgcatagctttagggtcttatggacatttggaccatttgcttcataatca

SEQ ID NO: 362422 - DNA, 451 bp, Homo sapiens
ttttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactt

SEQ ID NO: 362423 - DNA, 470 bp, Homo sapiens
caactctgggttgttttctgcactgacattttaataaatatttagtgacagtgagctcagaatcgtatctttggcaagtgcctggggtgcagctgccattctttattgatggctgagtaagatatgaggcgcttaacttttaactcatttttgttttgttttaacacagcctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaata

SEQ ID NO: 362424 - DNA, 1956 bp, Homo sapiens
gtgagcgggtttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362425 - DNA, 1741 bp, Homo sapiens
gtgagcgggtttccggaacctccgggtgtcatccgcggggaaaggctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362426 - DNA, 2006 bp, Homo sapiens
atgggaaaggagcatggcccagctgggtgtattagctctccctccgctgcacttctggaacctttcatataagggcttcaggataagggggttgcatagctttagggtcttatggacatttggaccatttgcttcataatcattttgaactgtttccttaggctctttattgagaaactaccaaaacatcgagattacaaatctgctgtcattcctgaaaagaaagacacagtaaaggtgggtcttcactttcattgttgcccatctaaaagcttcagagcagcacagactgacttcaagataaaagtagtagtctctgcatctgagtaccagatcctgcaataggagataaggccatttcaccacaacagttctgaagtagcagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactta

SEQ ID NO: 362427 - DNA, 1693 bp, Homo sapiens
gtgagcgggtttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaattaaactatatcatcagaataagaaagaatcgtccgtt

SEQ ID NO: 362428 - DNA, 631 bp, Homo sapiens
  misc_feature (603)..(603): n is a, c, g, or t
ggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggagcaggagtcgccagacagaagtcaccagacanaagtcgacgggatcctctagatcaccac

SEQ ID NO: 362429 - DNA, 604 bp, Homo sapiens
cttttgtgtatacatttctgttcccccatatatatagactttttatatttcagctgggcagcatttacttgctcttaatgtctccccataatttcccttcaggtgtggtactgcatgtgctttttcaaagccttgataatttaaatggcagaaatgctattattaactccatataaggtggttatgggtttgtcactcaggccatgtgtaacttgaatttttgtctaagcctcagaaaaacctgtttgtgaggccacttttcagaatttcttgggctttttggaaaattgaacgtctgtcttggatattggcttgagcttagatatggcaattccaccagtgattatttcagtgattgtgtgaattgttagaattaagataatttggtgttaattgcagtgattatttcaagttataagattgtaatctattataaacgtgttaaggatggaaggcacaaaacccaactatttttccatagtgaataatcttttttaatgcccaactcataggaagcctagcttctgttattgctactagtcttttgttgcatgaaagatttttgtttttgcatcagaattttgccatgatatttcagagagta

SEQ ID NO: 362430 - DNA, 898 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagca

SEQ ID NO: 362431 - DNA, 935 bp, Homo sapiens
  misc_feature (861)..(861): n is a, c, g, or t
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcntaaggagggtaaatcctggccgcagtgggacaatttatcccgctggaaaaccttatgtgggagaaggggggccc

SEQ ID NO: 362432 - DNA, 1099 bp, Homo sapiens
tcaccctccattggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttcccccgagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagca

SEQ ID NO: 362433 - DNA, 895 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcggcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccaggctcaccgcctggtggggaaagtgtgtttctccctggttccctgccactcattcacctcagacacagggtgggctctgggttcttcctcatgtggaaagtcggggcttcagaccatgtctgtcgtcatccagaagggatggagtcaaaagtgaggctggagttttgcaggatctccagacttccctgaggccactgagctgggctgtgcctctgtggacctcagggtggtcgctgagctgggctgtccctccctggaccttgaggtggtccctgagctggctctgcctctatggaccttgcggtggtggtccctgagctgggcagtgcctccctgaacctcggggcgatctcaggcagcctctgcctctgctgggaggagccatggcccctgggagaggctagaagccctggggacacattgccttgggtgtccctgacagggactatcatgggggtgtttgtggctgtgggcaccatccctgtcccttccagagtgccctgcatagaggcagacaccctgaagcctggtgaccctgggctctggctgggaaacccgggtcgtggggacgtgaaagggtgaggtggcagtgcctctgacctcttgcct

SEQ ID NO: 362434 - DNA, 240 bp, Homo sapiens
  misc_feature (34)..(34): n is a, c, g, or t
ggaggtgattctagaggatcccattaggcgcgtnctgcgtccacatcagcgaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcagaacgcgcctaatggggatcctcctagagg

SEQ ID NO: 362435 - DNA, 1320 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaatgtgggccgcttgggccaagtgaattttaaatttgacaaagtttatgaatggggccgaaattggggttaatttggcaaattccccttaaagggggccgattaaaaattaatgggccggggtttaaaaacgtcggaattggaaaaaccttggggttaccaaattaaatcgctttgaagatccccttttggcgttggggagc

SEQ ID NO: 362436 - DNA, 1145 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcaaaaaaaaaaaaaggaaaaaaaaaaaaaaaaaaaaaaaaaaaaaaaaatgtgggccgcttgggccaagtgaattttaaatttgacaaagtttatgaatggggccgaaattggggttaatttggcaaattccccttaaagggggccgattaaaaattaatgggccggggtttaaaaacgtcggaattggaaaaaccttggggttaccaaattaaatcgctttgaagatccccttttggcgttggggagc

SEQ ID NO: 362437 - DNA, 1205 bp, Homo sapiens
tcaccctccattggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttcccccgagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362438 - DNA, 1381 bp, Homo sapiens
tcaccctccattggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttccccccgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccaggctcaccggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362439 - DNA, 1423 bp, Homo sapiens
ggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggtgcctgaggtcagggcatcacagctgctgtgctagtgcccacgtttactgtctgcggctcctccttacctcaatgccacccaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362440 - DNA, 1342 bp, Homo sapiens
ggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcagtcacaggcttgctcccctagacagagggcaacgggagcagcagatggtccctgggattcctcagggtgcacatgaagcctgagcctcacattgctcctgtcctggcacagaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagca

SEQ ID NO: 362441 - DNA, 564 bp, Homo sapiens
cccgctacagttagcgctcctggcgcatacgtggagacaccttgcatgtacctggggggggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362442 - DNA, 1254 bp, Homo sapiens
ggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362443 - DNA, 1372 bp, Homo sapiens
ggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaatcactgtgcccggccggcacctcagcctcccaaagtgccaggattacaggtgtgaaccactgtgcccagccggcaccaaaacttgcacctatcctaaatatggagcttcagtgtaagtggcctcccagagacatctttgactttttaaaaaatctagttattgggttctgggagggaccttcctgtttgggggtaatgtggccccaagaaagacct

SEQ ID NO: 362444 - DNA, 599 bp, Homo sapiens
cagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggtgaggacgtcttctgtttccctggcagcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccaggctcaccg

SEQ ID NO: 362445 - DNA, 1004 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362446 - DNA, 1069 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctgtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgatacca

SEQ ID NO: 362447 - DNA, 676 bp, Homo sapiens
gccgaggccgctcccgcccgttgtccccgcagtccccgacgggagcgccatggcccagccgccgcccgacgtggagggggacgactgtctccccgcgtaccgccacctcttctgcccggacctgctgcgggacaaagtggccttcatcacaggaggcggctctgggattgggttccggattgctgagattttcatgcggcacggctgccatacggtgattgccagtaggagcctgccgcgagtgctgacgagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaaccactgtgcccagccggcaccaaaacttgcacctatcctaaatatggagcttcagtgccgccaggaagctggctggggccaccggccggcgctgcctccctctctctatggacgtccgagcgcccccagctgtcatggccgccgtggaccaggctctgaaggagtttggcagaatcgacattctcattaactgtgcggccgggaacttcctgtgccccgctggcgccttgtccttcaacgccttcaagaccgtgatggacatcgatacca

SEQ ID NO: 362448 - DNA, 973 bp, Homo sapiens
  misc_feature (880)..(880): n is a, c, g, or t
  misc_feature (883)..(883): n is a, c, g, or t
  misc_feature (891)..(891): n is a, c, g, or t
  misc_feature (898)..(898): n is a, c, g, or t
  misc_feature (906)..(906): n is a, c, g, or t
  misc_feature (908)..(908): n is a, c, g, or t
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctcttaaggggggtaatctggccanggnggatattnatcccgntggaaaancnttatgggtgcaaagagtggcacaacaacaaaaaaaaacacttttcgagaaggaggtgtagggcaa

SEQ ID NO: 362449 - DNA, 1180 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcggcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccaggctcaccggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362450 - DNA, 1339 bp, Homo sapiens
ggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362451 - DNA, 1113 bp, Homo sapiens
ctcacagcggccgggcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcagtcacaggcttgctcccctagacagagggcaacgggagcagcagatggtccctgggattcctcagggtgcacatgaagcctgagcctcacattgctcctgtcctggcacagaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacaccca

SEQ ID NO: 362452 - DNA, 1066 bp, Homo sapiens
ggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcaactccatgcaaaccatccaaaagaccaccacccgccggatagtggatggcaaagtggtgtctgagaccaatgacaccaaagttttgaggcattaagccagcagaagcagggtaccctttggggagcaggaggccaataaaaagtaaagagttc

SEQ ID NO: 362453 - DNA, 1049 bp, Homo sapiens
ggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccagcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagca

SEQ ID NO: 362454 - DNA, 279 bp, Homo sapiens
aatgtgataggtgttagcataaaattcctaccaaataatcaaatgaaaatattttcacacgagctaaaaaaaaaaaaaaatctattaataggattaaaaaccaaaacaaaacttccatatgtaagtgtgttcttcacataagaaagagcatctctgcaataggaatacataccaaaataccatcttctgttatccaaaaaaaacaactaagttacggctcacatgcaaattccaacccacctttggtaactaaatgggctttggtcacatgctaaatac

SEQ ID NO: 362455 - DNA, 392 bp, Homo sapiens
ggaataatgacaaaaagcagtctatccatgttcagtgtagaggcagccatcctaggcctaactacatagtacatgtcagcaacaatgtagcattttcttaaaatttttttttgcagcccggtgctcatgcctgtaatcccagcactttgggaggctgagtggggcggatcatgaggtcaggagatcgagaccatcctggctaacacagtgaaaccccttctctactaaaaatagaaaaaattagctgggcgctgtggcgggcgcccgtagtcccagctactatcgggaggctgaggcaggagaatggcgtgaacccgggaggtggagcttgcagtgagccaagatcgcaccactgcactccagcctgggcgatagagcgagaccccgtctca

SEQ ID NO: 362456 - DNA, 839 bp, Homo sapiens
tccgggcgtcggggcttcggcgggcattagcagcagctgagaggcctgtgagaggttctggggcgccaccgcagtcattctgttcagcgggtatagggttcttggataaacaagctctgacgatcattcccaaacaagagttcaaaaatgttttccgcaatagcaatgatatggacggaaaggatgccctcctgcaccgatgcctctggaggaccacattttccattcagagacacgctcagcactcaactcatgctgcacacccggccgaccccagtaccgacactcacagaatgcaggttggagagagatgccgacttccgaggaggtgtcttcttcggactgaacgtattcccaaagaaaggcatctttggcctgatgaaagcaaagccagtgctcccttctcctagggtcagaaaaagtcaggggtacaagcagctggatcactgaccttatgccattgtcttcaaatcttgaagacatacattttatcatgtggctactaacgatcctggtgctatggtttgaatgtccccaccaaaactcatgttgaaattgaattgccattgtttaacagtataaggggtgactgggccatgtgagctctgctctcatgaatggattaatgccattgtcatggagtaggttagttttctctggcgtgggctcctggcaaaaggatgagttctgctgccatgctgtctgtctcatgcacttgctcaccatgtgagccttctgcctcacacaggatgaccctcaccagatacttgcaccatgctcttggacttcccagtctccagaactgtgagccaaataaacttcttttctttataaattac

SEQ ID NO: 362457 - DNA, 897 bp, Homo sapiens
tccgggcgtcggggcttcggcgggcattagcagcagctgagaggcctgtgagaggttctggggcgccaccgcagtcattctgttcagcgggtatagggctcctctaggcccagtgggttgctggatttttaacagccacaagaaaccaacactaatgcagtgtgagcccctcagctggtctgtactgggcactgattaatgcctacttggtatgagacacttccaagccatgagccggctctacccctcttcctggaatgccttcatctaacctctattcctgccattatccttccacattcagctcagatatcccttcctctgggaagctctcccgacttgacagaaataacttctccctcgtgtgctgtgcagatcctgtgcagactccaactgggtccttatgtaattatgcttacggtcggtccacctgcctctacactgtgagggcaggaactgtgtcttgttccttgcgtgtggctttggatgcaaagcaacgtacctggccaaactggcattgaggagatatctgttggattaagtgactcgaggtggagcctccccaaaaggagaagctaggcctctcttccccatcacctgcctcaccatgtctaataagatgtccactttcagccgcaagagattgttctcttcctccaactgctggttccgcctgcgaaggcgctgaacctccctccggtccacaccgccactaacccctgtctctggaggaaggacagaaccagttaaagggggatttcctcctacaatcttgtttgacaaaatggcaggaagtgcagctcacctgctatccactggccattttcaaacttcaggctttgccctgccaggttcatagtcggggatccgtattccaagcccagctccacctcccgg

SEQ ID NO: 362458 - DNA, 1231 bp, Homo sapiens
ggtttgtttgttttctgagacacggtctcgctctgtcggccaggctgggtgcttttcttgtactaactcactatgaggtagatactacgattatgctcatttttaaaaaaaaacatccaggccgggcgtggtggctcatgcccagcctagtccttttttaaaaaaaaaaaaaagatggcatcttactttgcagccaaggctgctctcaaactcctgaggttaagccatcctcctgtcttagcctcccaagtagctgggactacaggggtgcaccaccacaattagctattatgccatttattgctgaagaaattaagttacagagcagttagtcagtagcagagctgggtgaggaacccaggccattttgctctggagtgtgtgctcttaaccactacagtgtatgctctcctgcctctgaaccttcacaggctcctctaggcccagtgggttgctggatttttaacagccacaagaaaccaacactaatgcagtgtgagcccctcagctggtctgtactgggcactgattaatgcctacttggtatgagacacttccaagccatgagccggctctacccctcttcctggaatgccttcatctaacctctattcctgccattatccttccacattcagctcagatatcccttcctctgggaagctctcccgacttgacagaaataacttctccctcgtgtgctgtgcagatcctgtgcagactccaactgggtccttatgtaattatgcttacggtcggtccacctgcctctacactgtgagggcaggaactgtgtcttgttccttgcgtgtggctttggatgcaaagcaacgtacctggccaaactggcattgaggagatatctgttggattaagtgactcgaggtggagcctccccaaaaggagaagctaggcctctcttccccatcacctgcctcaccatgtctaataagatgtccactttcagccgcaagagattgttctcttcctccaactgctggttccgcctgcgaaggcgctgaacctccctccggtccacaccgccactaacccctgtctctggaggaaggacagaaccagttaaagggggatttcctcctacaatcttgtttgacaaaatggcaggaagtgcagctcacctgctatccactggccattttcaaacttcaggctttgccctgccaggttcatagtcggggatccgtattccaagcccagctccacctcccgg

SEQ ID NO: 362459 - DNA, 2180 bp, Homo sapiens
ttctagccagtgacacttgggggcgggggtgacagctgagttggtgttccccttcattcgtttagttcagcgcgttgaagcgctcactgtgtcctaggcagacaccgtgctgtgcgcggggatcacagttatctagttcctctcgcgaggactccgagggacaggcagggtgctgcggagcgcacaggaaaggacctgaccctgtcgcagggaaggaaggtgatgcttaagctgagctctgaggaatgatgaagaatgagctcggcgaagggggtgctggtgtttgatgcagggctcagagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362460 - DNA, 2103 bp, Homo sapiens
  misc_feature (1)..(2): n is a, c, g, or t
  misc_feature (203)..(203): n is a, c, g, or t
nngagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcgggtccgggtcctgtgggtccaagggccgctgggcaggcggcgagnacttggccgaccttggcccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362461 - DNA, 399 bp, Homo sapiens
ttctagccagtgacacttgggggcgggggtgacagctgagttggtgttccccttcattcgtttagttcagcgcgttgaagcgctcactgtgtcctaggcagacaccgtgctgtgcgcggggatcacagttatctagttcctctcgcgaggactccgagggacaggcagggtgctgcggagcgcacaggaaaggacctgaccctgtcgcagggaaggaaggtgatgcttaagctgagctctgaggaatgatgaagaatgagctcggcgaagggggtgctggtgtttgatgcagggctcagaggtgggcccagtgttgggggttgagggccagtgtggctggagggcaagggggagagcaggagggctggctgcgaagcgtgcaggccttggtgctcagtg

SEQ ID NO: 362462 - DNA, 4164 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 362463 - DNA, 3550 bp, Homo sapiens
  misc_feature (219)..(219): n is a, c, g, or t
gggctaagacgtaaatcgcggagctgtcgacgcttggactttgtgaagacccgctttgcccctcaggtagctgggggctggctgattgaccatcagcgacttctactacacggtgatgtccggatcgatgccgagtccagttcagctgagtccgtccgagttccccttaggttctcctccatgagtcatgttacagccggccagatcatgcctcttacncagctaggacgcgcaagccacgtgcggtacttgctgggttcttctgtgcccaaggcactaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 362464 - DNA, 1985 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362465 - DNA, 2339 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaaaaaaaaaaaaaaaaaaaaaaacaaaaaaaaaaaaaaaaaagggggggccccaaaaaattcccccgcagggggccccaagtctaggcgcgcgttacccccagtttttgtgttgtcaacaagggggccccccccataagagggagggaggcgccgaattaaaaagcgacccagagagccacgcgggccgcaggggtttttcacaccaacgggctcgggagcggggggaaacacttcggctcaccggggagacaaccttgggggagaagagaaccccataactcgcgggggggggaggccacataggtggggcacaaagctccctcacggaggtttaacgagccccagggggaaatt

SEQ ID NO: 362466 - DNA, 3434 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtgatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362467 - DNA, 2167 bp, Homo sapiens
ttagccaggatggtctcgctctcctgacctcgtgatccgcccacctcggcctcccaaagtgctgggattacagatgtgagccactgcgcctggccgcagatctttaacagaacctttaagagtctggacttagagctaagtgttgggtgagggcagcctcttgggctggttttctcccctgtgaagtcatggctctgcagggcctggttttttggggcttgtgtggtgaccattaaatccccactgtggggggttgtttcacaagagggaaatctggtgctcctccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362468 - DNA, 2109 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaaaaaacagaccacacaaccagaaacaaaaaaaaagtgggccgccccgggcacaaaagaaacccccacggcgggccccgccttaagggaaaccgcagcgttcccggcgaaaaacagggggccccaa

SEQ ID NO: 362469 - DNA, 1876 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362470 - DNA, 2500 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtggtaaggggcattcccagggcaggggtatggtggggaaggttgggtgctgggcctgctgaagtactgtaaaaggttctgagactctccagttgagcactcctttctccagaggcctggaattggagcaaggccaccgtttcactccctccccctaagaagaaccaactatgatcctggggcacttcaggagtcagtgtatgtctgcctttctgtacagaggacgggaaggaaagcctggataatctctacactcagctacttcctctccccttccctgaccctcccaacattgactgccttagcagcagcaggtattcccttgggtggctggccagggtgtaggctggcaactggggaacctgccctcactataattgagagttgacttgcccctagagagtgccctgtccctaggtttgtggaattcagtctccacaaacctagagaggagaggacaaggacagtagttggattcattctctggggttgtagctgtctccgtctctttgctccagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362471 - DNA, 1922 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362472 - DNA, 1875 bp, Homo sapiens
agcggtccggggggcgggtcagcggaagtgagggcggttgaggctgggcggcccaaggtggaaggaggggccgtgaggtgagagagtccgggagcccgagcttgagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362473 - DNA, 2079 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaggacgggaaggaaagcctggataatctctacactcagctacttcctctccccttccctgaccctcccaacattgactgccttagcagcagcagaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362474 - DNA, 1553 bp, Homo sapiens
agcggtccggggggcgggtcagcggaagtgagggcggttgaggctgggcggcccaaggtggaaggaggggccgtgaggtgagagagtccgggagcccgagcttgagaccatcccaatctggcaaaacaagccacatggggctgctcgaagtgtagtaagaagaattgggaccaacctacccttgaagccgtgtgcccgggcgtcctttgagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362475 - DNA, 1372 bp, Homo sapiens
ctattttcacacaggggcaaggaaaaaccagaaacaacttctctcttaccctttaaactaagatacttcattctacacgattacctgaaacaaatgtctcaggtcaaatcacaagccttagcttctgctagggtttgaagtctgggaaatatataatccagctctttccccctcctcctctctctttcctaccgggcttaaagtccgtggaagagaaagtttttaatcagtggaactgataaggcctcagggccgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362476 - DNA, 3116 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgcccctgccctgtcactcctctaacacttccctcccctgtccccaacatgccctgtaataaaattagagaagactaa

SEQ ID NO: 362477 - DNA, 1843 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcatccgtactggcccgggaactaccatactgttttctatatcagttgcatcattttacattcctattaacatgtagaaagattccagtttctcca

SEQ ID NO: 362478 - DNA, 399 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgtttgtatgtaccacaccatgcatgactcagatgccctcaggtccctttctctatggtatgtatactgcttgtgtttgggttgaagcactacctgacattaaaggaaggacttggagagagaa

SEQ ID NO: 362479 - DNA, 290 bp, Homo sapiens
gtgtattctgcagtttctgattggctcatcatggcatctgtaaatgttgatgacttttgcttctccatagaccctgcccaacatctctgacctgtgtttgagagatgtgcccccagtccctaccctggctgacatcgcctggattgctgcggatgaagaggagacatatgcccgggtcaggtagttgaggcagtagctggtctgctaaggaatggagaacttcccagaagaggtggcaggcagcaaggagagaggaatgagaactgtgggctcagagaggagcagaacct

SEQ ID NO: 362480 - DNA, 529 bp, Homo sapiens
tgggggaaggaaccttaggagcacagtggcctgctgtctctaactgatctacttggttttccctggtccaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcaggtaggagcccctgtgccagggccagaacgtaacaggctgttcctttcccctggctcttgggcaggataggggtaaagaaagtggtaatccttggtttgcaggtacttaggttccgggccctggggttgtcctgaagcctggctagccagtagtgcctcttagatggtttctaccagccattttgggctgaatggtttggttaagaacaaaatattaacctgtgaccccaggcagagtccctccctt

SEQ ID NO: 362481 - DNA, 4335 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcttgttctgtcacccagactggagtgcagtggtgcagtcacagctcactgcagcctcaacttccctggctcaattgatcctcctgcctcagcctcctgaggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 362482 - DNA, 4233 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 362483 - DNA, 4247 bp, Homo sapiens
cccttgactgagttcctctcagtcccagaagacctagaaaagggtcgtggttggtcatgggtttcgagtaaacaggcctgggtttcaatcccgattcccccaccatctagctgtgtgacctggggaggtgactttacctctctgaacactttctcatttgtcaaatggagttggtaatgttattatctgcctccctaggctatcctgaaactaaaatgcgatacactggttgttactttggtgactgttaacaccccagctacccccaccccctgcctggctccgttaatcaccagctagtgtggatgatgagggagaggtgagccctgtagcataagggcagtgcctctccgatgtctgtgtctcatagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 362484 - DNA, 2171 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaaaaaaaaaaaaaaaaaaaaaaacgtttgcggccgccgcagccggccccggcccttgggcagcttggcgggccgcacgggctgcgggaactcgtcggccaggcacacgaagtgcggcatcaccgcctggtaactggagcagatgcccatcagctcgccgggcttggcggccatggcgcctccggcgtc

SEQ ID NO: 362485 - DNA, 4301 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcatgcagcgccctcgcgacaagccatacgataagtccatcggctgtgctctctctacgcctcctattatcatgatctgcagaatgcgctgccctccactcgccatccctagctccctacgagctgccgttgcgcagtggcgctacaacgataccgactgagaggtggtcaccgatcacgtcctctggtcctaccatagggtggcgtctggagatatcacgagacggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 362486 - DNA, 3973 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccctgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 362487 - DNA, 1931 bp, Homo sapiens
gctcgtgccgaattcggcacgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362488 - DNA, 4587 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctcccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaaaaaaaaaaaaaaaaaaaaaaacaaaaaaaaaaaaaaaaaagggggggccccaaaaaattcccccgcagggggccccaagtctaggcgcgcgttacccccagtttttgtgttgtcaacaagggggccccccccataagagggagggaggcgccgaattaaaaagcgacccagagagccacgcgggccgcaggggtttttcacaccaacgggctcgggagcggggggaaacacttcggctcaccggggagacaaccttgggggagaagagaaccccataactcgcgggggggggaggccacataggtggggcacaaagctccctcacggaggtttaacgagccccagggggaaatt

SEQ ID NO: 362489 - DNA, 3629 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtgatggcctgatatgaaggagtcacgcctcccgcctcccggagctgcccagtggctgccttgtccttcaagtgcaggagctggttcaaatgtcaggaatggaagccactgtggtaaggggcattcccagggcaggggtatggtggggaaggttgggtgctgggcctgctgaagtactgtaaaaggttctgagactctccagttgagcactcctttctccagaggcctggaattggagcaaggccaccgtttcactccctccccctaagaagaaccaactatgatcctggggcacttcaggagtcagtaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362490 - DNA, 2362 bp, Homo sapiens
ttagccaggatggtctcgctctcctgacctcgtgatccgcccacctcggcctcccaaagtgctgggattacagatgtgagccactgcgcctggccgcagatctttaacagaacctttaagagtctggacttagagctaagtgttgggtgagggcagcctcttgggctggttttctcccctgtgaagtcatggctctgcagggcctggttttttggggcttgtgtggtgaccattaaatccccactgtggggggttgtttcacaagagggaaatctggtgctcctccagatggcctgatatgaaggagtcacgcctcccgcctcccggagctgcccagtggctgccttgtccttcaagtgcaggagctggttcaaatgtcaggaatggaagccactgtggtaaggggcattcccagggcaggggtatggtggggaaggttgggtgctgggcctgctgaagtactgtaaaaggttctgagactctccagttgagcactcctttctccagaggcctggaattggagcaaggccaccgtttcactccctccccctaagaagaaccaactatgatcctggggcacttcaggagtcagtaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362491 - DNA, 2434 bp, Homo sapiens
  misc_feature (1)..(2): n is a, c, g, or t
  misc_feature (203)..(203): n is a, c, g, or t
nngagtccccgaagggtagttgctcgtcggagttccccagcaaacagtgaccaagccagacctcaggcttctagtttcggcttcgctgcttgacgggccgggctgccccgccgcgcattctgagacctggccgcggctcggaggcttccgcgcactcgggtccgggtcctgtgggtccaagggccgctgggcaggcggcgagnacttggccgaccttggcccaggtcgggtcgtctgccgcgggggaggggcgactcgccctggcgggtccccgcggggagagggtccgcgcgggtctccggccactgctgcgcgcggcaaagtttcactgagcgcggcggcctccgtgggggcccccgggaccaggggtgctgagcagggccctgcgctggaggagctcccgttctcctgaggggacgcctgtcagcagacagcaactgcagcctccggagggctgcggggcgcagagatggcctgatatgaaggagtcacgcctcccgcctcccggagctgcccagtggctgccttgtccttcaagtgcaggagctggttcaaatgtcaggaatggaagccactgtgaggcctggaattggagcaaggccaccgtttcactccctccccctaagaagaaccaactatgatcctggggcacttcaggagtcagtaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362492 - DNA, 1965 bp, Homo sapiens
agcggtccggggggcgggtcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagtgatacgcgccccctgaggcacacctggaaacccagccctctgattgtcatgcagcgcaatgcctctgttcccaacctgcgtgggtccgaggagaggcttctggccctgaagaagccagctctgccagccctaagccgcactactgagctgcaggacgagctgagccacttgcgcagccagattgcaaagatagtggcagctgatgcagcttcggcttcattaacgccagatttcttatctccaggaagttcaaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362493 - DNA, 3946 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagtcttgctctgtcacccaggctggagtgctatggctcgatcttggctcactgcaacctccacctcccaggttcaagcaattctcttgccccagcctcccgagtagctgggattacaggtgcatgccaccatggctggctaatttttgtatttttagtagagatggggtttcaccatattggtcaggctgatctggaactcctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgcgtggattgccagagccgaatgtccagcac

SEQ ID NO: 362494 - DNA, 2085 bp, Homo sapiens
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctacgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaacaggagaactcgtcccaccagaagctggctggcctgcacctggagaagtacagcttccccgtggagatgatgatctgcctgcccaatggcaccgtgatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagagaa

SEQ ID NO: 362495 - DNA, 1310 bp, Homo sapiens
gctgattgtccatcaaagatgacaaatttggttttgagtattgttatgaagtcatgaacagaaacacatttgatggagtccctttgtaccaattaaagtgctcatgccgaactaagatttgctaagcaggacaaagatctgattcttcaattaactctctagtgaggtctgacataaattacagttcctctttcccccgtctctgccttggctctccactccaggcgaccactttatcaagttcttcgctccgtggtgtggtcactgcaaagccctggctccaacctgggagcagctggctctgggccttgaacattccgaaactgtcaagattggcaaggtgagtgaaagcccttattaaactggaaatggactgctttgggctggattaattagcagagtggcccattattcattccgtgtgcaaagtcgcaaacttgatttattaattccatttagtgtgccacttgataattcatttcaccttcacagatggcagtctgattttgagttttgctggcttttccacagcctagagataaattatggcctcggctgctttgtttattttgaagagatggccaaatctgaattggcagccccagagcccgttctgcaaagagatggggtagagccttgtagaatgttcactggacgaacttggagaccgtccacgttcgacctcacccaagagctctctctaaaaggaccctggctctgtgctcccccaagcacgcagaagaccctccctcagtttgcactgtgcctgggattctttccagcatttcctactttatacagagaagccaagagtggtgtctgacaacttctgtgtaactggattttctggaaatatccagtgtagctccagggacatcacttttattcttctacactttccagcacccaccagacaccatgcatagatttcctttcttaaaaatctcatttttctaccttgccatggggctgatttgtatccaaaagtaatgctgcgtgtctaggactgaatgatggttaacaggatgatctacttgggatggtgagatggtcaaaagcataaacttgggggttgggtagacctggctggctgaccttgggaaaaacctctccacgcctcggtctccccctttgcaaaactgagctaagatctactgtgtggtgtctgggcagatgaaagtacactgcttagtgtgatgcttagcatggggcagatgcttggtaaattgtaatcacttttgttgtcagttaaatggatatttcactgttgcctcttaaacgcttacgataatatatactaattatacaaa

SEQ ID NO: 362496 - DNA, 321 bp, Homo sapiens
aagaaaccaagacccacttaatacttgtcctgtctgaaggccagcaagaatacaccaaggccaaggccaatttctttcgggaaccccaaggcccccttcttgcccccttttaaaaaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362497 - DNA, 2963 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362498 - DNA, 2542 bp, Homo sapiens
ttacggctaggtacgaggctgggtggtggcttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362499 - DNA, 2573 bp, Homo sapiens
  misc_feature (29)..(29): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (57)..(57): n is a, c, g, or t
ggtggactgcacggcccactttagaccangatagactttggcgtnttncanggatanccacttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362500 - DNA, 3609 bp, Homo sapiens
  misc_feature (1274)..(1274): n is a, c, g, or t
  misc_feature (1496)..(1496): n is a, c, g, or t
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtacgtctgcacttcttagtactgagaattcttcatctcttaaccccatcaggctgagctactgagtggtttaatgggcacagtgaattgccaatcttgattgttagggcactggtttggagaaatgtgtataatgaaacaaacgtctttctcttaattgataagatttgggttgtggagatgaaccttgaaacatttcagtggcccaggttatcactagaataacccacatcttacagtcacagggtaactgtgctctggttgtaaacacaaaccttcaggcctttgaacagagctaaggcttgcacttggtccggttctgcctgcctccctccctccttccctggccgatggtcagcagctcagagttccccatcagcacaacggcttgctggcaggcctctgccccagacttctntgatgtgtaaccccgtggagggaagaggggcctgtacagttctctcaccaaagccgaggcattcagttatcctctctacattcccgtctaaatatgaacatgcagactttgcaccaccgctaagacatctgggagctctgacccgggcaagcaggggttgcaggaaggcttaagtgattcagaacacctcagtggactcactcagccgcgtgcccgtgtctnggccaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362501 - DNA, 2870 bp, Homo sapiens
  misc_feature (535)..(535): n is a, c, g, or t
  misc_feature (757)..(757): n is a, c, g, or t
actgggaagttgatctgcttttattctcaggttgattgtacacagcactatgaactctgctccggaaaccaggttcgtggctatcccactcttctctggttccgagatgggaaaaaggtacgtctgcacttcttagtactgagaattcttcatctcttaaccccatcaggctgagctactgagtggtttaatgggcacagtgaattgccaatcttgattgttagggcactggtttggagaaatgtgtataatgaaacaaacgtctttctcttaattgataagatttgggttgtggagatgaaccttgaaacatttcagtggcccaggttatcactagaataacccacatcttacagtcacagggtaactgtgctctggttgtaaacacaaaccttcaggcctttgaacagagctaaggcttgcacttggtccggttctgcctgcctccctccctccttccctggccgatggtcagcagctcagagttccccatcagcacaacggcttgctggcaggcctctgccccagacttctntgatgtgtaaccccgtggagggaagaggggcctgtacagttctctcaccaaagccgaggcattcagttatcctctctacattcccgtctaaatatgaacatgcagactttgcaccaccgctaagacatctgggagctctgacccgggcaagcaggggttgcaggaaggcttaagtgattcagaacacctcagtggactcactcagccgcgtgcccgtgtctnggccaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362502 - DNA, 2912 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaatggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362503 - DNA, 3526 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaagtctggtctttccttcaatgttacagcaaaacagatataaaatagacaataaattatagtttatatttacaaaaaaagctgtaagtgcaaacagttgtagattataaatgtattatttaatcagtttagtatgaaattgccttcccagtacatgattgtgaaaaagacatttagaaaatattctaaaatttaatctgagcctcactttctacaagggaaatcatgatttccgttcataaacagcatgctcatccccctaacaccattcttataagctgggcaccctcattttattttcttcgttggttctaaccctgtggcgtggtatgctgtatagtaaaaaggcagagaaccactttactgaaaaggtactagagccggcagtccagaagttaatgtgctggtcaaagaaccgttctggtaaagaagaggtgagcattgccttcacgtgttacacggttacacaccccttgtagcctcacctcagtgtaatcagtctacttttggtactagcaaagagtacagcaaatggaggattgaggtgtagaaatggtatgttttgg

SEQ ID NO: 362504 - DNA, 3117 bp, Homo sapiens
  misc_feature (2966)..(2966): n is a, c, g, or t
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaacnacacgaaaaaactccgagggctctaatccggggccgggaaaagagggtctggaatgggcatgggccaaagcgggtccctgaaccacttttcttgtcacagggagattgcgggccccaaagggggcgataaattcgaaagccggtacgattg

SEQ ID NO: 362505 - DNA, 3051 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaatttttttttttttttttttttttattgtttattgtgtatttttttttttgaaaaaaaggagggggtaagggttcagggggaaaaattt

SEQ ID NO: 362506 - DNA, 3014 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaagtcgacgcggccgcgaatttagtagtagtagtagtagtaggcggccgc

SEQ ID NO: 362507 - DNA, 3023 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaagaagaaagaagaaaaatcaaaaacaaacaacaagaaaagaaacaacaaaaaagaggg

SEQ ID NO: 362508 - DNA, 2562 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagcaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362509 - DNA, 1827 bp, Homo sapiens
ggggcgcccggggggggctgagaggtaggagcgtggcagctgcgtgaagcgggaagtagtgctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362510 - DNA, 2864 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactctttacccacctctatcccacagggacgggattcttgccccaaagtgcccaggtatgacccttagaacactaccgtattctgggttgcttgagacaattatcccgaataacccgccgtccttgactaatggactgtttttacagccaatgttacaaataaaccccagttaataaaccctactgtaaccaacaccagctgctatactggccgtcttaataaccgagggggtccgaaccattgccttt

SEQ ID NO: 362511 - DNA, 2522 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362512 - DNA, 1015 bp, Homo sapiens
tgactctagcaggatccccttaacagctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362513 - DNA, 2081 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccagaaggtccaggtatgccagataggtccaggtatgtccagaaggtccaggtatgccagaaggtccaggtatgccagaaggtcaggtataccggggatct

SEQ ID NO: 362514 - DNA, 830 bp, Homo sapiens
aggaccccccgcgacagagtgtgctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362515 - DNA, 966 bp, Homo sapiens
ggttaggagattgagaccagcctggccaacatagtgaaaccccgtctctactaaaaatacaaaaattagccgggtgtggtggcaggtgcctgtagtcccaactactcaggaggctaaggcaggagaattgcttgaacccaggaggcagaggttgcagtgagagaaaaattaaaatgaataatcaagcatgaagtcaatgcagagagagacctgagcaagccaggcctggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362516 - DNA, 1964 bp, Homo sapiens
  misc_feature (1786)..(1786): n is a, c, g, or t
  misc_feature (1788)..(1788): n is a, c, g, or t
  misc_feature (1810)..(1810): n is a, c, g, or t
  misc_feature (1818)..(1818): n is a, c, g, or t
  misc_feature (1821)..(1821): n is a, c, g, or t
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttagncncagtgatcatactggtggccgncagggccnatngaagaaaccaccttggagatacttcacggcggtgtggacttctgggcggaaactcctcaggtgaaggtgccggtgaaaggtatctgacgggcgagaaaagtgtcgacacttggggatgcacaacagggggcccgtccgggaaa

SEQ ID NO: 362517 - DNA, 740 bp, Homo sapiens
  misc_feature (36)..(36): n is a, c, g, or t
gacggagactctcgacagttgtgcttctctaggagnttgggtttttttaaaaaaagaattatctgtgaaccatacgtgattaataaagatttcctttaaggcagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362518 - DNA, 591 bp, Homo sapiens
  misc_feature (24)..(24): n is a, c, g, or t
tgatggtgactctagagtatcccntacgagagaagagacgagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362519 - DNA, 1503 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcacagcaccagcacgaattcccttagcaccagcacgaattcccttagcaccagcacgaattcccttagcaccagcacgaattcccttagcaccagcacgaattcccttagcaccagcacgaattccctt

SEQ ID NO: 362520 - DNA, 1232 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaggattcctggtctgggggggtcagaacgcgagaacggcgggaagggattgcggcagttcgggacggacccggatgttccgagagggaaaagcaagggga

SEQ ID NO: 362521 - DNA, 538 bp, Homo sapiens
  misc_feature (32)..(32): n is a, c, g, or t
  misc_feature (80)..(80): n is a, c, g, or t
  misc_feature (90)..(90): n is a, c, g, or t
  misc_feature (122)..(122): n is a, c, g, or t
  misc_feature (165)..(165): n is a, c, g, or t
  misc_feature (174)..(174): n is a, c, g, or t
  misc_feature (176)..(176): n is a, c, g, or t
aaaaaaaaaaaaaaaaaaaaataaaaaaaaanaaaaaaaaaaaaaaaaaaaaaaaaaaaaaaaaaaaaaaaaaaaaaaanaaaaaaaaanaaaaaaaaaaaaaaaaaaaaaaaaaaaaaaanaaaaaaaaaaaaaaaaaaaaaaaaaaacaaaaaaaaaaaaaanaaaaaaaananaaaaaaaaaaaaaaaaaaaacacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362522 - DNA, 1739 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggtgagtgaaagcccttattaaactggaaatggactgctttgggctggattaattagcagagtggcccattattcattccgtgtgcaaagtcgcaaacttgatttattaattccatttagtgtgccacttgataattcatttcaccttcacagatggcagtctgattttgagttttgctggcttttccacagcctagagataaattatggcctcggctgctttgtttattttgaagagatggccaaatctgaattggcagccccagagcccgttctgcaaagagatggggtagagccttgtagaatgttcactggacgaacttggagaccgtccacgttcgacctcacccaagagctctctctaaaaggaccctggctctgtgctcccccaagcacgcagaagaccctccctcagtttgcactgtgcctgggattctttccagcatttcctactttatacagagaagccaagagtggtgtctgacaacttctgtgtaactggattttctggaaatatccagtgtagctccagggacatcacttttattcttctacactttccagcacccaccagacaccatgcatagatttcctttcttaaaaatctcatttttctaccttgccatggggctgatttgtatccaaaagtaatgctgcgtgtctaggactgaatgatggttaacaggatgatctacttgggatggtgagatggtcaaaagcataaacttgggggttgggtagacctggctggctgaccttgggaaaaacctctccacgcctcggtctccccctttgcaaaactgagctaagatctactgtgtggtgtctgggcagatgaaagtacactgcttagtgtgatgcttagcatggggcagatgcttggtaaattgtaatcacttttgttgtcagttaaatggatatttcactgttgcctcttaaacgcttacgataatatatactaattatacaaa

SEQ ID NO: 362523 - DNA, 1415 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggtaagggggacgtcctgatgccagcttcagagaatcactattattccttggcgtgctgggcttttccttcctgctactcaagggctcttagatagcagcatcagtggcactgacaaagggtcactctagaggagctgttgggaccgttgttcagtgcacctcctctaaaacatgagttctccttttgtctgtgcccttatagaaacgccgagtctaatgctaagcacacgtgacccgcacactagctggacagtgcatccttggctaagagtgtttattgacagactcacctcgcttgattgctctttactttattgcactttggagatactgcatttttttacggattgaggattttggcagcccagcatctggcaggtctagcggtttttccagcagcttgtgcttactttgtatccctctgtcagcatctttttagcaataaaatattttttaattaaggtacattgtttttaaagaagtaatgctgtagcacatttcatagactatagtgtaaacataactttgatattcactagggaaccaaaaaatttgtgtgacttgttttattgtgatattatctttattgcagtggtctggaaccaaacccacagtatctcggaagtatgcctgtgtattaatgataatcatatgcttaatgacctcaggcagaaacaaaagcttctctctgtctaaacagaatttagattgggcacagtggctcatgcctatcatcccagcacttggggagaacaaggtggg

SEQ ID NO: 362524 - DNA, 784 bp, Homo sapiens
cggcacgaggagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgtcggcagcccagcatctggcaggtctagcggtttttccagcagcttgtgcttactttgtatccctctgtcagcatctttttagcaataaaatattttttaattaaggtacattgtttttaaagaagtaatgctgtagcacatttcatagactatagtgtaaacataactttgatattcactagggaaccaaaaaatttgtgtgacttgttttattgtgatattatctttattgcagtggtctggaaccaaacccacagtatctcggaagtatgcctgtgtattaatgataatcatatgcttaatgacctcaggcagaaacaaaagcttctctctgtctaaacagaatttagattgggcacagtggctcatgcctatcatcccagcacttggggagaacaaggtggg

SEQ ID NO: 362525 - DNA, 2879 bp, Homo sapiens
ccggaggccgcggcgaggcgcgcccagccccgccgcgatgcccgcgcgcccaggacgcctcctcccgctgctggcccggccggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362526 - DNA, 3025 bp, Homo sapiens
aaacatgagtcctttcccttcctcatttgtgtgtttgctttaccagtgagttttatacttttgggtgttttcatgatgatagatattgtcctttcactttcaggtgtagagccctggtaagcatttactgtagggctggactagtggtgatgaatttcctcagtttctgcttgtctaggaaagaccttatttctccttcatttgtgaaagataactttgctgagcatagtatacttggctaacagttttttttttttctttcagtacttcgaataggccattttctcctggcctgtaaagtttctgctgagaaatctcttgtaagtctgatggaggttcccttacttttgactagacacttttctcttgctgtttgtagaattttctgtcttgggctttggatagtttgactatcacgtgccgcagggaagaaccttttgggattttatctgtttgctctctgataagacaactttctttttgctctgtctaatcctttgttattctttcagcttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362527 - DNA, 3277 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaaaaaaaaaaaaaaaaaaaaaaaacgacgaaaaaagaaaaaagggcggtccgaatccccgggccagtacgtcccgtgtgtaaaggggccaaaaggacgaattatagacaggcaggggcgcgttaacacggttgtgcggcaaaacgttatgggaatttggaagggaccctcttggtgggtgacatattgacacatacctaggaattagcttaggataataaaatttagggtttaatggttaacaagggattttctgggttaaaatttgctgtcgaaatttttttgaaaatttttttctggacttttaaataggggtt

SEQ ID NO: 362528 - DNA, 2909 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362529 - DNA, 3042 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaatttttttttttttttttttttttttttttttttttttttttttttttttttttttttgggggggcagaaaaaatccggg

SEQ ID NO: 362530 - DNA, 3043 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaattttttttttttttttttttttttttttaaattttttcagggggggggcgggggggggaaagggaaaaggggggccaggg

SEQ ID NO: 362531 - DNA, 3042 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaattttttttttttttttttttttttccctaaaattttccaggggggggaccggggccggaattggaaccgggggcaaagg

SEQ ID NO: 362532 - DNA, 2117 bp, Homo sapiens
agcaccaccacgccaggcctcagtgaggaatctaccaccgtctacagcagcagcccaggctcaactgaaaccacagtgttccctcgcagcaccacaacctcagttcgtggtgaagagcctacaaccttccacagccggccagcctcaactcacacaacactgttcactgaggacagcaccacctcgggcctcactgaagaatctacagccaagccccagcgcgctgagctgcacatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362533 - DNA, 2548 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362534 - DNA, 2338 bp, Homo sapiens
  misc_feature (2300)..(2300): n is a, c, g, or t
  misc_feature (2309)..(2309): n is a, c, g, or t
  misc_feature (2316)..(2316): n is a, c, g, or t
  misc_feature (2326)..(2327): n is a, c, g, or t
  misc_feature (2332)..(2332): n is a, c, g, or t
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagcctgttgaagggcctaactaaagttaaaattcggaacngtcaaaacnttaaagncgaaaatggnngtcanggggcc

SEQ ID NO: 362535 - DNA, 690 bp, Homo sapiens
ggtgggcgctatggccttggtgggcgctatggccttggttgggcgctatggccttgtgtgggcgctatggccttggtgggcgctatggccttggtgggcgctatggccttggtgggcgctatggccttggtgggcgctatggccttggtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 362536 - DNA, 1564 bp, Homo sapiens
  misc_feature (1379)..(1379): n is a, c, g, or t
  misc_feature (1394)..(1394): n is a, c, g, or t
  misc_feature (1397)..(1397): n is a, c, g, or t
  misc_feature (1400)..(1400): n is a, c, g, or t
  misc_feature (1407)..(1408): n is a, c, g, or t
  misc_feature (1414)..(1414): n is a, c, g, or t
  misc_feature (1425)..(1425): n is a, c, g, or t
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccnggttagatcagtccncgngcntggtccnngtgtgncgaaggactcnaggggggacccttgggggggtccagcagccccaactaaataggcccacgaagggaccgccggaactccgggaaaccgcccgaaagggcggaaagagagaagatgcggtggacacacccggggcctaggcgaacaggact

SEQ ID NO: 362537 - DNA, 1318 bp, Homo sapiens
  misc_feature (1157)..(1157): n is a, c, g, or t
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatattgctcctgggtgggcctggtaaaccgggccactgtgaggaacctctaaaagaatcctggtctgggggggcaanaccgaaaaacgagcgcagaacgaatctagcccaccttatgagaaggacctctatttctttctgagcgacatcacctgcgccctaggaaaccttaccactgtcacacacaaactacgccgcgagtctctcagcccaactatcgtcgagatcactccagacac

SEQ ID NO: 362538 - DNA, 441 bp, Homo sapiens
ccggaggccgcggcgaggcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaacagtcctgcttcccagcgcaccccagggaagcggccatcaagcggccagca

SEQ ID NO: 362539 - DNA, 256 bp, Homo sapiens
tcaggaagctgaagtgggaggatcacttgaacccaggagttcaaggccagcctgggcaacatagtaagaccccatctcaatttttaaaaataaattttgaaaaagattgtttaatgaataatttatttctattcattaaaaaattagactattggctgggtatggtggcacatccccgtaattccagcactttgggaggctgaggcaggaagaccacttacagctaggagtttgagaccagcctggacaacatatt

SEQ ID NO: 362540 - DNA, 381 bp, Homo sapiens
atttcatatattactgataattcataatgaattttaggattccattcaattacatactaaaaattacattttttatagtggcaatgtacttttatcagtattcttatttgacggtcaatttgagttcagtgtaaacaaataggacttagaaaaataatttgtaactcaagatgctgtacctcatcctataattgttgttttgtaatattccttctcaggaatatgggctaaggatatctcaactctgtcagatttgttgataagaatttaatagtaaggagttcttatagcctataaaaagcatgaattatgagatcaaatgtgggagttactatatgattatctgcattacaaaatgaaagcaaatgctttatttattcc

SEQ ID NO: 362541 - DNA, 591 bp, Homo sapiens
tgggttgaatgagagataaagaaaattaataggaagaacatcctgcatacaataaccgttttgttttcccaatttctatagggttgaagctttgagagaagcagcaactgctgttgagcaagagaaagaaatccttctggaaatgatccacagtatccaaaatagccaggacatgaggcagatcagtgacggtgagagccatctccacagaaggggctcatcttttacactcctttaaagagtttatgataagtgtgggtcaatttttgcttgacttttggtatgcgtacaccaggccacagcatttaatgtgagccacagagagcagctgcagctgtcagttcattacagcagccacttactcagagatttcttccagcatgctctctaccccaagcccctggctaggagagataggaaaaagcctgcaagctcagaaaagctggccccaagcagtaaggccatgtgttttatcccaggttcacagtcctaacttcagttcctcacaagttactggactgcaagagattaaaaaagcagaggaagagggtgagagagtggaagcagagaagtagagaccaaaaaaaaaaa

SEQ ID NO: 362542 - DNA, 2066 bp, Homo sapiens
cgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttcca

SEQ ID NO: 362543 - DNA, 1637 bp, Homo sapiens
cgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccaccta

SEQ ID NO: 362544 - DNA, 2259 bp, Homo sapiens
cgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtgggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttcca

SEQ ID NO: 362545 - DNA, 2318 bp, Homo sapiens
ggcgggccggggcctggggcacagtgaggctgcggcaaccgaagttgcttgttgagatttgttgtggatggacgtggtgtagttttgtttgtttcttggattatctcccctagtccgagagaaaacgcattcgatttaagctaaacctgtgagggcgttatcggtggccacactttgattaatttacctaggtgttagggagcggaaaaaaatcagaggagataaaagttacagtgagattccatgcgattaaggactgtggcagcttgggtctgcagaacttctagaaccttctgtgtggccccaaacgttttaacttactcttctcgttatgcattttttaagggaggcagcagtttacagtggccctccacgtgaagttaagtttccttgcttcagaacaaaaatgaataaaacaaaaccaacccagcaatccattgagagcaaagattagacaggagtgaggggtaggcagtaagttaccgggtgcttcgtgcagcagagacgttgccgcttctgtttctcccctaacctcgcggacgggattcagcggttccgttcgtctctcgggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtgggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttcca

SEQ ID NO: 362546 - DNA, 2205 bp, Homo sapiens
cgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggagccacataacaagtaacacacatctctccatgtcttcagaacgttgagggcatgttctcaaccacttcattctcctctcccttagccagaaagaaaagttttcctaaaggaatggggaggttgttactccactccgccttccttcaagctgagtcattgtcctccaacttgaattaatgcctcacatgtgggttgaagctttgagagaagcagcaactgctgttgagcaagagaaagaaatccttctggaaatgatccacagtatcctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttcca

SEQ ID NO: 362547 - DNA, 844 bp, Homo sapiens
  misc_feature (21)..(21): n is a, c, g, or t
gagcatttacaccttgtgtantgtgtaaatgctcttaggtttgaagactaattgaatctgctttcagcatttgttgcagagtttggaaccagctcctttagaatgctctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaactta

SEQ ID NO: 362548 - DNA, 1020 bp, Homo sapiens
cgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggttgaagctttgagagaagcagcaactgctgttgagcaagagaaagaaatccttctggaaatgatccacagtatccaaaatagccaggacatgaggcagatcagtgacggtgagagccatctccacagaaggggctcatcttttacactcctttaaagagtttatgataagtgtgggtcaatttttgcttgacttttggtatgcgtacaccaggccacagcatttaatgtgagccacagagagcagctgcagctgtcagttcattacagcagccacttactcagagatttcttccagcatgctctctaccccaagcccctggctaggagagataggaaaaagcctgcaagctcagaaaagctggccccaagcagtaaggccatgtgttttatcccaggttcacagtcctaacttcagttcctcacaagttactggactgcaagagattaaaaaagcagaggaagagggtgagagagtggaagcagagaagtagagaccaaaaaaaaaaa

SEQ ID NO: 362549 - DNA, 1779 bp, Homo sapiens
cgggtagttcctgggtccggggagcagacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaactta

SEQ ID NO: 362550 - DNA, 2227 bp, Homo sapiens
ggcgggccggggcctggggcacagtgaggctgcggcaaccgaagttgcttgttgagatttgttgtggatggacgtggtgtagttttgtttgtttcttggattatctcccctagtccgagagaaaacgcattcgatttaagctaaacctgtgagggcgttatcggtggccacactttgattaatttacctaggtgttagggagcggaaaaaaatcagaggagataaaagttacagtgagattccatgcgattaaggactgtggcagcttgggtctgcagaacttctagaaccttctgtgtggccccaaacgttttaacttactcttctcgttatgcattttttaagggaggcagcagtttacagtggccctccacgtgaagttaagtttccttgcttcagaacaaaaatgaataaaacaaaaccaacccagcaatccattgagagcaaagattagacaggagtgaggggtaggcagtaagttaccgggtgcttcgtgcagcagagacgttgccgcttctgtttctcccctaacctcgcggacgggattcagcggttccgttcgtctctcggtatttattgggcacctccctacatagaagactaagtgctagttactggcctgaaagcatgaaaagatagttttccccttttcttgcttaagaatttatttgggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttcca

SEQ ID NO: 362551 - DNA, 2251 bp, Homo sapiens
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgctctttgagggtggatttcatcgtgtctatcatgaacgacagggactccttctcagagtaattctgtcttgaatcaaaatatccgtggactgctttgatcaacaggacatggcctgcagcttcctgatggaatgcgcacacagctccctgctgatgaagtcaatgctgttctctgcccaggcgagcctctggtctctgttcagaaccagacctgtgggcaccttcgtggttcctctttgcaggagaactccccgcactcctcactcaagtggctattgctcttcagtaacctctgcagcagct

SEQ ID NO: 362552 - DNA, 795 bp, Homo sapiens
agcaaccatgactggctttgtctctgccgtgtgtcctatttggacttgaacgtgaatgcagccatacaacacgtagacggttgtgtctgacttcatccacttagtgcgatgttttcaaggctcatccatgctggagcccatgtcagtgcttcgtttctttttatggcttaaaaatcgtctatggtgggccacgcacggtggctctcgcctgtaatcccaacactgggaggccgaggcaggcggatcatgaggtcaggagatggagagcagcctggccaacatggcgaaacctcgtctctactaaaaatacaaagataagccaggcgtggtggcgggcgcctgtagtcccagctactcgggaggctgaggcaggagaatcgtttgaatccaggaggcagaggttgcagtgagtcgagactgggctcactggttatggagccttacctgggcatgccccccgctgacacctgtggaaaggcatgggacagccccggcccatcccctgctgcctgagccctcccctcctctgaccttcctccttccatgaccctgctgccaggggggcttcccaaaaaagatcttgagtcttagcgatgtggtcgacacgcagagaacttggagcctcatgccagggccccctcccagagattcctgcagcttcctgatggaatgcgcacacagctccctgctgatgaagtcaatgctgttctctgcctgcagagacaaaaacatggtgaattctcgtcacaaggcacaggcactctcgtgggcacgaaacccatctctgttggggtg

SEQ ID NO: 362553 - DNA, 2807 bp, Homo sapiens
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggag

SEQ ID NO: 362554 - DNA, 2123 bp, Homo sapiens
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgcttgagagttctatagctttcctatttctattccaaagtttttatttatctggattttgttcctaagatctttttatactttatgttctattttttttcgttttttattcatatatattctatattgtttttattactaatgattttttatataatctgtatagtgataacatat

SEQ ID NO: 362555 - DNA, 2083 bp, Homo sapiens
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgagtgtccaccaaaggagacagggctgggagcgctgcccggggcccaggtcctccctaatgacagcatgcacgaaagcccgcttctcacatctgattccaggagaaagagcggcgtgtccagcaagataagtttatccaccatctcggggaaggtacagaaaaactgtgaggatgccaaaaggggagaatgaatagggggaagaaggaaaggacactcccgcctttccctggggaccctggagttccccgaaacatcttttaggctggggggagggtgctgaccaagaggccagaggagaatcttctatctatggtgtgccttcccccaccacccctaagtctgcacccagcactgagctccagaccttggtgatggctggactccagggtgctggtgggactgggtatgggggcgtggaaacatgaactctaccaggagtctccaccgtttacaccaacttcctggtataaggactatcactgtgacaggaggaggcactttctgtcccaggtaccttctccttcctcctttgtgctcccctccccactccacccaagggagccccagttggccagacaaagccatctactcaccattccgcccacgacgccacctgggggacaaaagagctgtgggtgacattccctcactccctccccagctgcataccctaaagcttcttcccaccagttggggggggggcaccatatgggtggctgggggctcagcatctgggccatgatgtccccttcatcagacctgaccactcaaaagaccacatttccctcatccctgtgtcccttgcggcagttgcctgaggtcagagggtacagtggtcaacctctgactgaccctctcatctctctttgcagatctcata

SEQ ID NO: 362556 - DNA, 2533 bp, Homo sapiens
cccggcggcccccgcgcgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggag

SEQ ID NO: 362557 - DNA, 2415 bp, Homo sapiens
ggaggagaggggaaactacggctaggtacgaggctgggtggcgcgctcccgggtggcaagatggtggcgcgcaggaggaagtgcgccgcgcgggacccggaggaccgtatccccagcccactgggctacgcaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggag

SEQ ID NO: 362558 - DNA, 3340 bp, Homo sapiens
  misc_feature (1366)..(1366): n is a, c, g, or t
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcattcaacaaggcaccaagtccacctggcctcagaagaggactctttttgtcttcaatgtgcccccatactgcacagagcaggagagcctgtcctgcctccagtccacctgtggccttgtccagtctgtagagttgaaggagaagctggagctggctgggagtcaaggtcgaagttttttcatccaaagccagttccgggtttccaggtagcctacgtggtgttccagaagccaagtggggtgtcagcggccttggccctgaagggccccctgctggtgtccacagagagccaccctgtgaagagtggcattcacaaatggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccaaaaagagctgctcaactacgcctggcagcatcgagagagcaagatggagcatctagcgcagctgcgcaagaagtttgaggaggacaagcagaggatcgagctgctgcgggcccagcgcaaattccgaccctactgagccgtgagagccgcagtggatggctggaggtgcagggccaggaggaacatgaggtgaggcagggcctgcagcggtctctgagaggccgagctctggccaacgggccccaggttgaaggccatcgcgtccaacagccccatcagagtccacacaggccaggagtgaaggaccaggccacccctcgggtcttgtgcttcagcagtcctggagacccaggcgtgccnagaggaggacttgtccttcccacctcttgcctccacacccttgaggaccctggatgaatccgttctgtgcttccttttccctcaatgcaaaagcccttgctggcaacaaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcatgtgtgtgcactgtaagaaggagctgatgatactggccacgtgctggggttcgctcatgtggacacagtgattgcctgggacttccacaaactggaactgctggagaggggagggggtgggtggtgaggtgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcggggccgaggccagggttgctgtgattgtatcagaagaggtacccgtgagaaaagataatgagatgggggcgtgaacagcctgcagacttgtgtctgccttcaagaagccagacagggccgggcgcagtggctcacgcctgtattcccagcactttgggaggccaaggcaggcgggaggccaaggtgggcggatcacgaggtcaggagatcaagagcatcctggttaagacagtgaaaccccgtctctactaaaaatacaaaaaattagccgggcgtggtggcgggcgcctgtagtcccagctactcgggaggctgaggcaggagaatggcatgaacccgggaggtggaacttggagtgagccgagatcgggccactgccctccagcctgagcgacagagtgagactccatctcaaaaaaaaaaaaaaagtgtgactattagctgggcatgatggcatgcgcctgtagtgccacctactcaggtggctgaggtgggaggatcatttgagcccaggagtttgaggctgcagtgagctatgactgagcctgagcaacagaatgagaccctgtctctcaaaaaatgtgggactgtctctggcagttgggtcacctaattgtgcctggccccaagaaggaggggtgggtacttgaggatggtaaagaacctccccaccaaaggtctctgtttcttaaattctgattacatgtgtccccaggcctctagggactgatcactggagcatgaggcctgatagatcctggtggtcacttgttgggcctgggggcagaccaggggtctttcccagtgcatgagaagagatgggtgaggtgggaccagagtgggcgacagtggctggacaccagctgcctgagccccgccttacctctttgagggtggatttcatcgtgtctatcatgaacgacagggactccttctcagagtaattctgtcttgaatcaaaatatccgtggactgctttgatcaacaggacatggcctgcagcttcctgatggaatgcgcacacagctccctgctgatgaagtcaatgctgttctctgcctgcagagacaaaaacatggtgaattctcgtcacaaggcacaggcactctcgtgggcacgaaacccatctctgttggggtg

SEQ ID NO: 362559 - DNA, 923 bp, Homo sapiens
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaacgcgcaagagaggagggtcccgctgtctaggcgtccgcttctaag

SEQ ID NO: 362560 - DNA, 834 bp, Homo sapiens
ggaggagaggggaaactacggctaggtacgaggctgggtggcgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggtcggaggccatggtgcccacagtctcccggcttgggcagatgtggctgtggctgagtccttcagcggcgctggacccctggcagcgccacccatggtgcagggaggctttgggatggccctgcggatgctcacacttggcttccctctccctgcggcaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaacgcgcaagagaggagggtcccgctgtctaggcgtccgcttctaag

SEQ ID NO: 362561 - DNA, 516 bp, Homo sapiens
ctctgatctggggactccaagggcaggagctctcagcattttctctatccctagttctcagcacgtggagtacagaggagaagcttcataaatgcagctgagtggattaattccgggaagctcccgtaaggaccagctcccctaagttacacccgatactcctgcaccattgtgaatataaaattgccatgaacacacacacacacacacacacacacacacacacaaattgctatgaacacacacacaccagtgaaaactcactgccctgtttccaccctggccctccagctattttctgcttctcagactaaaatgacctgaagtgccttccctgaaacaggggttcccatactgttcccaaggcctgcgtgttctcatatgtcagctgccacatctcacagcggggtgtgaccaagctttttgggcctgcacacaggaggggcttcctgggcacaaggtgaacaggcaaacttgaccctgtctctactaaaaatatgaaaattagactgggca

SEQ ID NO: 362562 - DNA, 390 bp, Homo sapiens
  misc_feature (386)..(386): n is a, c, g, or t
cccaccattttgggaagctgaggcaggtggatcgcctgaggtcagaagttcgagaccagtttggcaaacgtggtgaaaccccatctctactaaaattacaacaaattagctgggcatggtgtcaggcgcctgtaatcccagctactcaggaggctgaggcaggagaattgcttgaacccgggaggcagaagttgcaggcagccaaactcgggccaccgcactccaccctggatgacagagtaagacttggtctctaaataaataaataaatagaaggtaggtgctttgcttcagcagcacatatactgctaaattggaacaacaaagagatgattagcgtggcccctgtgcaagcgtgatacgaaaatttgtgaaatgttcctttncaag

SEQ ID NO: 362563 - DNA, 367 bp, Homo sapiens
ggagaaaggaagttgtgtgagtgtctcgctggcctcagctcagggtagcctggccatccctcccctcccatttcctttccagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggtgagctagtgtctgtctgggaggagacctgtgggctcaaggtgggggctcccatggcctccaccaagtccttggtggtgagacggacacagctaatgggagccccagaggagagtgtcaggagggctaccgtgatctccag

SEQ ID NO: 362564 - DNA, 2067 bp, Homo sapiens
  misc_feature (2063)..(2063): n is a, c, g, or t
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcattcaacaaggcaccaagtccacctggcctcagaagaggactctttttgtcttcaatgtgcccccatactgcacagagcaggagagcctgtcctgcctccagtccacctgtggccttgtccagtctgtagagttgaaggagaagctggagctggctgggagtcaaggtcgaagttttttcatccaaagccagttccgggtttccaggtagcctacgtggtgttccagaagccaagtggggtgtcagcggccttggccctgaagggccccctgctggtgtccacagagagccaccctgtgaagagtggcattcacaaatggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccaaaaagagctgctcaactacgcctggcagcatcgagagagcaagatggagcatctagcgcagctgcgcaagaagtttgaggaggacaagcagaggatcgagctgctgcgggcccagcgcaaattccgaccctactgagccgtgagagccgcagtggatggctggaggtgcagggccaggaggaacatgagttctcagcacgtggagtacagaggagaagcttcataaatgcagctgagtggattaattccgggaagctcccgtaaggaccagctcccctaagttacacccgatactcctgcaccattgtgaatataaaattgccatgaacacacacacacacacacacacacacacacacacaaattgctatgaacacacacacaccagtgaaaactcactgccctgtttccaccctggccctccagctattttctgcttctcagactaaaatgacctgaagtgccttccctgaaacaggggttcccatactgttcccaaggcctgcgtgttctcatatgtcagctgccacatctcacagcggggtgtgaccaagctttttgggcctgcacacaggaggggcttcctgggcacaaggtgaacaggcaaacttgaccctgtctctactaaaaatatgaaaattagactgggcacagtcactcacgcctgtaatcccaccattttgggaagctgaggcaggtggatcgcctgaggtcagaagttcgagaccagtttggcaaacgtggtgaaaccccatctctactaaaattacaacaaattagctgggcatggtgtcaggcgcctgtaatcccagctactcaggaggctgaggcaggagaattgcttgaacccgggaggcagaagttgcaggcagccaaactcgggccaccgcactccaccctggatgacagagtaagacttggtctctaaataaataaataaatagaaggtaggtgctttgcttcagcagcacatatactgctaaattggaacaacaaagagatgattagcgtggcccctgtgcaagcgtgatacgaaaatttgtgaaatgttcctttncaag

SEQ ID NO: 362565 - DNA, 2742 bp, Homo sapiens
acaccatcctcttagttgctcagactgaaaagctagcagccatcctggatttctctcacactgcctattcaacgtgtgaatgcatgagtggaaagctgagttcgcactcgtgactggccggggtcgactctgacattcactcccactttggcgcgctgatttgcctctgagcggatgaaggttgagccatggcgggcggggccggggaggcgggcttggagcgagggggcggggcaggcgccacaaaaacgcgctcgcgccggcgccgaaccgcaactcccggcgacccccgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggag

SEQ ID NO: 362566 - DNA, 2558 bp, Homo sapiens
ggaggagaggggaaactacggctaggtacgaggctgggtggcgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggag

SEQ ID NO: 362567 - DNA, 2496 bp, Homo sapiens
tgcgccgagtggttatcgcctggccggtaccctgtgtacgagactgtatcccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccgggtttccaggtagcctatgtggtgttccagaagccaagtggggtgtcagcggccttggccctgaagggccccctgctggtgtccacagagagccaccctgtgaagagtggcattcacaagtggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccgaaaagagctgctcaacttctacgcctggcagcatcgagagagcaagatggagcatctagcgcagctgcgcaagaagttcgaggaggacaagcagaggatcgagctgctgcgggcccagcgcaaattccgaccgtactgagctgtgagagccgcagtgaatggctggaggtgcagggccaggaggaggcgaggcagggcctgcagcggtctctgagaggccgagctctggccaacgggccccaggttgaaggccaccgcgtccaacagccccatcagagtccacacaggccaggagggaaggaccaggccacccctcgggtcttgtgcttcagcagtcctggggacccaggcgtgccgagaggaggacttgtccttcctgcttcttgcctccacaccctcctctccaggaccctggatgaatccgttctgtgcttccttttccctcaatgcaaaagcccttgctggcaacgaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcccagagctacagctgggctgggagcgtgtgtgtgcactgtaagaaggagctgatgatactggccacgtgctggggttcgctcatgtggacacagtgattgcctgggacttccacaaactggaactgctggagaggggagggggtgggtagtgagatgtggccagaggagcctagggagctccatgggccccggggtcagggccctcccacagcattccagctccctgcaggtcaggagcgcctcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccagacaggaaggccctgcctgccttggctctgacctggcggccagccagccagccacaggtgggcttcttccttttgtggtgacaacgccaagaaaactgcagaggccccagggtcaggtgtaagtgggtaggtgaccataaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggag

SEQ ID NO: 362568 - DNA, 544 bp, Homo sapiens
  misc_feature (387)..(387): n is a, c, g, or t
  misc_feature (397)..(397): n is a, c, g, or t
  misc_feature (401)..(401): n is a, c, g, or t
  misc_feature (446)..(446): n is a, c, g, or t
  misc_feature (496)..(496): n is a, c, g, or t
  misc_feature (539)..(539): n is a, c, g, or t
cccggcggcccccgcgcgcgctcccgggtggcaagatggtggcgcgcaggaggaagtgcgccgcgcgggacccggaggaccgtatccccagcccactgggctacgcagctattccaatcaagttctctgaaaagcaacaggcttctcactacctctatgtgagagcacacggcgttcgacaaggcaccaagtccacctggcctcagaagaggactctttttgtcctcaatgtgcccccatactgcacagaggagagcctgtcccgcctcctgtccacctgtggcctcgtccagtctgtagagttgcaggagaagccggacctggctgagagcccaaaggagtcaaggtcgaagttttttcatcccaagccagttccggttttcaggnagcctacgtngtgntcagaagcaagtgggtgtaagcggctttgccttgaaggcccctgntgtgtcacaagagcacctgtggtgcattacagtgatagtgctaccaactntggcccaccttaggcttaggtggtggcacgtatgagctatacngactc

SEQ ID NO: 362569 - DNA, 781 bp, Homo sapiens
ctcgtgccgaatctcggcacgacgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggaggacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctga

SEQ ID NO: 362570 - DNA, 1335 bp, Homo sapiens
  misc_feature (641)..(641): n is a, c, g, or t
ctcgtgccgaatctcggcacgacgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctntctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctga

SEQ ID NO: 362571 - DNA, 312 bp, Homo sapiens
aattcgcggccgcgtcgactacggctcgagaagacgacagaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctga

SEQ ID NO: 362572 - DNA, 781 bp, Homo sapiens
ctcgtgccgaatctcggcacgacgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctga

SEQ ID NO: 362573 - DNA, 405 bp, Homo sapiens
tatttttaatcccagaatttttagttgtcttggaattagaattggaagtttgtttaggggagccagtcctcaatgatgtcataaataaaagtccttccttgattatttgattgcatatcttatcttatactactagaaactcatcttttggtgaatataacaagtcctttctttcctcataggttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttct

SEQ ID NO: 362574 - DNA, 882 bp, Homo sapiens
ctcgtgccgaatctcggcacgacgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctga

SEQ ID NO: 362575 - DNA, 572 bp, Homo sapiens
  misc_feature (1)..(1): n is a, c, g, or t
  misc_feature (100)..(100): n is a, c, g, or t
  misc_feature (116)..(116): n is a, c, g, or t
nataactcaaccctctagccgacccaatgactcgcatatgctcagttcatcggactgatgtcaatgcgccgtctgcttgccgggctcagatacgtcactntatcgctgtgctcacncacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcataccacaccagacagatgcgttcagccgatgaagggcaaactgtcttctacacctgtaccaactgcaagttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctga

SEQ ID NO: 362576 - DNA, 338 bp, Homo sapiens
gatcctcccacctcagtctcccaagtagcgagggctataggtgtgtgtaccacagctcccagctgcatgtactttaaaaatgtgtctaagccaggcgtggtggctcacgcccgtaatcccaacactttgggaggcggaggcgggtggatcacctgaggtcaggagttcaagaccagcctgaccaatatgacgaaaccctgtctctactaaaaatacaaaaactagccgggtgtggtggtgcgtgcctgtagtcccagttagtcaggaggctgaggcaggagaatcacttgaacccaggaggcggagtttgcagtgagccaagatcgtgccagtgcact

SEQ ID NO: 362577 - DNA, 391 bp, Homo sapiens
tccctcttccaaaataaccacttcactaataaaagatggtgctcttaatctaagaaatttagtaagcctccccaaaccttcacacctattattgctgattgagaaaaaataagaccttacaaaaatgaaccaaacatggaagctgacatttgtacacaactactacaggaagaaaatagaaaatgaaaatcaaaacatttcacgtaatgaatattctccctcaaaaaacagtcatgaagcagaagaaaattgttacacaatctaccaatctgaattaaatgtccttaaacatttgcagataagacaaaacaccttaaatcagaaattcaaaaacttaaagccaaaatggataaaaaactgcatgctgtgaaatgaaagtttactaaactca

SEQ ID NO: 362578 - DNA, 1466 bp, Homo sapiens
gaggtgggaactaaaacagaggcggtggaagaagttgcacaaggctagagagatcactgctggagggaaaagcatgatgggctctcgggttttgagaactggcaagttgttggaggcagctggagcggggcctgggtcgccggcactggctgtctttgcgtttgggcgtggccagtcactcctcttccaggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggactggcagtttgtggccatggtagtggaccgcctcttcctgtggactttcatcatcttcaccagcgttgggaccctagtcatcttcctggacgccacgtaccacttgccccctccagacccctttccttgaagactggagggttgagacccaggccccctgccagttgaagtgagagtttggtgatactgtcaagccctatccttctctgcctcttaactccttcacgaggaatctgggcctcttatttcgtttctggggactgcattggactgagggctgggtaggcaggtgtcttggacccacctgaaatgcagtatcatctgatttactctttgggatcttgaagaagctcttttgggtatcaacacctaggtcgccagtgaaatagaacacagaacaggaactagattataagccttatgaggtcaagaaatgtgacttggccgggcgcggtggctcacgcctgtaatcccagcactttgggaggccaaggcgggcggatcacctgaggtcgggagtttgagaccagcccgaccaacatggagaaaccctgtctctactaaaaatacaaaattagccaggtgtggtggtacatgcctgtaatcccagctactagggaggctgaggcaggagaatcactcgaacccgggaggcagaggttgcagtgagtcaagatcacgccattgcactccagcctgggcaacaagagcgaaactccatctcaaaaaaaaaaaagtgtcttgttcactgcagcatgcccagtgccacgcacaggtgctgacctatagtaagtgcttaacatttgttgaataggggaaagaaatttccggaagtaaatacagcaattaataatgtttataagctgggcatggtcgctcaggccagtaatcccagtgacttaggaggctgaggtgggaggattacttgaaacccacagtttgagaccagcctgggcaacatagtgagaccctgtctctaaaaaaataaaaatagaaataaagtagtgcttattgtttgcatgttgggtcttgtggtcgttttctttttacctttctgtaatttattatgttttgtaatgtgtactatctctgggattaaaaaaagttatttctacaa

SEQ ID NO: 362579 - DNA, 236 bp, Homo sapiens
atgagatgcattttgggggggtgagtacttttttcaaaaaaaagaaaaaaaaaattttctccccccaaaaaaaaaaaaaaaaaaaaaaaaaaaaaaaaaaaaaataaaaatagaaataaagtagtgcttattgtttgcatgttgggtcttgtggtcgttttctttttacctttctgtaatttattatgttttgtaatgtgtactatctctgggattaaaaaaagttatttctacaa

SEQ ID NO: 362580 - DNA, 371 bp, Homo sapiens
gaggtgggaactaaaacagaggcggtggaagaagttgcacaaggctagagagatcactgctggagggaaaagcatgatgggctctcgggttttgagaactggcaagttgttggaggcagctggagcggggcctgggtcgccggcactggctgtctttgcgtttgggcgtggccagtcactcctcttccaggttccagcctgaactgtctgcccctgatctgcggcgatttatcgatggtccaaaccgggctgtggccctgcttccggagctacgggaggtcgtctcctctatcagctacatcgctcgacagctgcagaaggaggacagcagcaggagcaggaggaggcaggggaaggaggccgccgtagga

SEQ ID NO: 362581 - DNA, 2906 bp, Homo sapiens
cgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaacacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgaaattcttttaaaaactattgtctaactacaaaaataatggcatatacatgcataaaccatctttaattagaaaatttagtaacagtcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctac

SEQ ID NO: 362582 - DNA, 629 bp, Homo sapiens
tgctttagcaaatatgcctcataataattgctaaggagtgtgttacaaagttatctcttgcctttctttttctttctttgtttctagtcattgtagtcacatacactgctgtggtgatggttccatttacaaataaagtctgtttttttggtttttttttcttaaagagatgtggcctgtctatgtggaattgaccaatgaaaagatatatggctgcgatttcattgtcagtgctacaggagttacaccaaatgtagaaccttttctccatggtaacagtgtaaggtgaaatttttttgtccagctgtgaatatatttgaagtatttttgtgaagatctctaattctcaaacatgaataattattattttagtgtacaactgtaacttaacatggttggaaacagtttggttaaaacattgtcttgatttacggtattttttactgcttaaaatccttacatagttatatccttgcataagcgtcatcagtaatggtttataatgtacaatttatttatctaaatgttggtaagagactgacacctcccgtgacttctcaaaaatgattcttttagagaaaccatcttgtattttttgcttttcagcacttgaagcttacaaaaaaaaa

SEQ ID NO: 362583 - DNA, 1961 bp, Homo sapiens
tatttaatagaaatgctactaaaacaggtgtgattggtatcatcttttaattttagaggcagtaatttagatagaattaacaaataccaaaaatcagtctgattagttatccattggtgactgcttctgtggcaaagatgacagaaagactgtcaaacattgaactcctttaagtgaatttacaaggttaacatttttcagataatgatcatgaaaaatgacattgtgtaacattttttcatcatttcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaacacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgaaattcttttaaaaactattgtctaactacaaaaataatggcatatacatgcataaaccatctttaattagaaaatttagtaacagtcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctac

SEQ ID NO: 362584 - DNA, 1561 bp, Homo sapiens
gccgtaattttaatatctgaacaactttcttccccaaaatatgtggtttcaccataatatccatattttttcttccccagcaactttctctttgctgttgttctctcattttcgccccccccccacagatgtgggtttttcccacaaaatcactaccaccgtctttttttctccccaccttgttttttatatactcctcgccccttcttgtttttatttaataacctcctcttttatggaccccttcttcaaaaaatggtgcttattcccccccccgcggaattttcttcccccccccccctcctccttttttttttttttttttttttttttttttttttttttttttttttttttttttttttttttttttttttttttttttttttttttttttttgaaatcagttcaaagtttatttatagatatatctttccaacacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgaaattcttttaaaaactattgtctaactacaaaaataatggcatatacatgcataaaccatctttaattagaaaatttagtaacagtcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctac

SEQ ID NO: 362585 - DNA, 464 bp, Homo sapiens
tttgactatattcaccagaattttttaatgtcagtgtagagtgtgtgatagtgtcatctgtagaattaacgcatgctgttgaaacattttctttgggactctccccaataacatttttagttatgaaattttgtggcataagttttctgcggctattcaaacttgacacaaaataactacccattacattttctttatgatactcatgacaataacctttttatctctaaatataggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgat

SEQ ID NO: 362586 - DNA, 3128 bp, Homo sapiens
cgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaacacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgaaattcttttaaaaactattgtctaactacaaaaataatggcatatacatgcataaaccatctttaattagaaaatttagtaacagtcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctac

SEQ ID NO: 362587 - DNA, 1421 bp, Homo sapiens
cgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagtgtaaggtgaaatttttttgtccagctgtgaatatatttgaagtatttttgtgaagatctctaattctcaaacatgaataattattattttagtgtacaactgtaacttaacatggttggaaacagtttggttaaaacattgtcttgatttacggtattttttactgcttaaaatccttacatagttatatccttgcataagcgtcatcagtaatggtttataatgtacaatttatttatctaaatgttggtaagagactgacacctcccgtgacttctcaaaaatgattcttttagagaaaccatcttgtattttttgcttttcagcacttgaagcttacaaaaaaaaa

SEQ ID NO: 362588 - DNA, 2886 bp, Homo sapiens
ggccggtggcggcggccggccggggaggcggcctcggcgcacagtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaat

SEQ ID NO: 362589 - DNA, 1000 bp, Homo sapiens
ggctcacacctataatcccagcactttgggaggccaaggcgggcggatcacttgagcctcaggagttcgagaccagcctggccaacatggtgaaaccctgtctctattaacaatacaaaaattagggtgcgatggctcacgcctgtaatcccccagctccttgagaggctgtggcaggtgaatcacttgaacgtgggaggtggaggttgcagtgcactcgagcctgggtgacagagggagactctgtctcaggaacaaacaaaaaaaaagctagtggaccaaggttagactatcagtgggagttaggtggaatgggtggagggggcagctaaggaaaagataagcactttaggtagagaaaatagtaagggtaaaggcaagtgtatgaatcaggctgatgtgttcagtgatctctaagcagagagaagttcctagattatgatgtcacagtagggagtaccaggaggagaggaagcttgggtgccatgttgcagttgagcccaaactgaatgctgtctgtagaaggaaacaacaaactttgtactttatgtacagagtaacatggtcaactttttggcttagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcattcattatctttaccttggagacacttggtggtggtcatcgtactgataagatggcatagctttatcatggaacagtctggagtataaccaccaggaggtcctgacctctgtgttgctctggtgtcattgttcctgtggacaaatgagctgttacctccaaaatgccttgtcacagtagttggaggcagcatatgaaacacctagttcccagaatcataatctaataccgtgtctggccccaaagttataaatgggctttgccttaagtcttatct

SEQ ID NO: 362590 - DNA, 615 bp, Homo sapiens
ggctcacacctataatcccagcactttgggaggccaaggcgggcggatcacttgagcctcaggagttcgagaccagcctggccaacatggtgaaaccctgtctctattaacaatacaaaaattagggtgcgatggctcacgcctgtaatcccccagctccttgagaggctgtggcaggtgaatcacttgaacgtgggaggtggaggttgcagtgcactcgagcctgggtgacagagggagactctgtctcaggaacaaacaaaaaaaaagctagtggaccaaggttagactatcagtgggagttaggtggaatgggtggagggggcagctaaggaaaagataagcactttaggtagagaaaatagtaagggtaaaggcaagtgtatgaatcaggctgatgtgttcagtgatctctaagcagagagaagttcctagattatgatgtcacagtagggagtaccaggaggagaggaagcttgggtgccatgttgcagttgagcccaaactgaatgctgtctgtagaaggaaacaacaaactttgtactttatgtacagagtaacatggtcaactttttggcttaggtaggttatttttgtgtctttgataagggcaag

SEQ ID NO: 362591 - DNA, 4233 bp, Homo sapiens
accattgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362592 - DNA, 4279 bp, Homo sapiens
accattgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaattgattcctttttttcttaaatatttataaatgttaaattaagtct

SEQ ID NO: 362593 - DNA, 4599 bp, Homo sapiens
ggctcacacctataatcccagcactttgggaggccaaggcgggcggatcacttgagcctcaggagttcgagaccagcctggccaacatggtgaaaccctgtctctattaacaatacaaaaattagggtgcgatggctcacgcctgtaatcccccagctccttgagaggctgtggcaggtgaatcacttgaacgtgggaggtggaggttgcagtgcactcgagcctgggtgacagagggagactctgtctcaggaacaaacaaaaaaaaagctagtggaccaaggttagactatcagtgggagttaggtggaatgggtggagggggcagctaaggaaaagataagcactttaggtagagaaaatagtaagggtaaaggcaagtgtatgaatcaggctgatgtgttcagtgatctctaagcagagagaagttcctagattatgatgtcacagtagggagtaccaggaggagaggaagcttgggtgccatgttgcagttgagcccaaactgaatgctgtctgtagaaggaaacaacaaactttgtactttatgtacagagtaacatggtcaactttttggcttagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362594 - DNA, 4077 bp, Homo sapiens
attcgcagtggtcgcttcttctccttggatttgttaaggattccaagtaactcttatttgatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362595 - DNA, 4589 bp, Homo sapiens
tccctgccgaccccggaccaaaagtagcgctgcagccgaccgaaccgcgtcctcccgccccgtcctcccctcccccacgccgggacggcctcccgggggaggccccgaggaaaaaaatccaggctcgaactccgccccctgccggccgccagcaggagtgaagcgccacaatccaacaatgaaatggaaccggggaggggcggcgggaaggttatagtgccatcatgtggatactttgttttcttcaaataaaatgtaacctttttataacagagactagaaaacccagccatcccaacacccaggctgtgcaaagaaattggggccaaacgtttttttgccatgttctgaaaaggatagaggcactctccattcctgattgttccaaggctcaagtggtcagaaatgactgggaagaagggagaaaaactcaggtggcaaaggacatggacgaaaacccatggcgacatggaaagaaaaccctgtgatatagagaggaaaagcacaggacagcttattggggagaatggaactcttctgtatcctgattgcggtgatggccacgcatggctatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362596 - DNA, 4157 bp, Homo sapiens
agatggtatcctgtaagtgacctcggctccccagagcgctgacccgtaagccctgccaccccctggactggatcccgggcctccccaacccgatcttggccgcctctcccgcggccccattttccttcgaaggagggaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362597 - DNA, 4185 bp, Homo sapiens
accattgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362598 - DNA, 2150 bp, Homo sapiens
ttttggtttttataaatataaatgttttatttttaaatgtaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362599 - DNA, 2354 bp, Homo sapiens
accattgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaacaaatggaacagagctagaagtgcagttgatgtgtagaggataacctatggccaacaacaaatagttaggatcatcaaagcacggagagtccctcggcgcgaaccatatagtacaaagatgataagc

SEQ ID NO: 362600 - DNA, 777 bp, Homo sapiens
tgggttccggaccctgccggggcggcggggcgggcaccgcccgagggggtagggcgcgcgcgggggcgcgccgggccggggaggcgcgctcgctccgcgctcccttcgctcgctcgtttcctcctccctcggcagccgcggccgccgccgccgccgcctccgcccaccttcctcgccggggcttcgtctttcactccttcgggctgcctccccctccccttgtcccctgccccttgccctgcttctgcagaagagcgctgacccgtaagccctgccaccccctggactggatcccgggcctccccaacccgatcttggccgcctctcccgcggccccattttccttcgaaggagggaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcattcattatctttaccttggagacacttggtggtggtcatcgtactgataagatggcatagctttatcatggaacagtctggagtataaccaccaggaggtcctgacctctgtgttgctctggtgtcattgttcctgtggacaaatgagctgttacctccaaaatgccttgtcacagtagttggaggcagcatatgaaacacctagttcccagaatcataatctaataccgtgtctggccccaaagttataaatgggctttgccttaagtcttatct

SEQ ID NO: 362601 - DNA, 693 bp, Homo sapiens
tccctgccgaccccggaccaaaagtagcgctgcagccgaccgaaccgcgtcctcccgccccgtcctcccctcccccacgccgggacggcctcccgggggaggccccgaggaaaaaaatccaggctcgaactccgccccctgccggccgccagcaggagtgaagcgccacaatccaacaatgaaatggaaccggggaggggcggcgggaaggttatagtgccatcatgtggatactttgttttcttcaaataaaatgtaacctttttataacagagactagaaaacccagccatcccaacacccaggctgtgcaaagaaattggggccaaacgtttttttgccatgttctgaaaaggatagaggcactctccattcctgattgttccaaggctcaagtggtcagaaatgactgggaagaagggagaaaaactcaggtggcaaaggacatggacgaaaacccatggcgacatggaaagaaaaccctgtgatatagagaggaaaagcacaggacagcttattggggagaatggaactcttctgtatcctgattgcggtgatggccacgcatggctctttcaaccagaattgtgtaggacagacacaaaaatagcctgttcatctgggcgcacgatcggccctcctatatgagatcagttgggagcttttccccttcagagccggaagcagtgcccc

SEQ ID NO: 362602 - DNA, 570 bp, Homo sapiens
caatgacttgtcagccagagtaacggctgttgtcaggtcttcagggtctcgaggttatagtgccatcatgtggatactttgttttcttcaaataaaatgtaacctttttataacagagactagaaaacccagccatcccaacacccaggatagaggcactctccattcctgattgttccaaggctcaagtggtcagaaatgactgggaagaagggagaaaaactcaggtggcaaaggacatggacgaaaacccatggcgacatggaaagaaaaccctgtgatatagagaggaaaagcacaggacagcttattggggagaatggaactcttctgtatcctgattgcggtgatggccacgcatggcttagagacgggctttcaccacgttgactaagctagtcttgaactcgtgacctcaggtgatccacctgcctcagcctcgctaagtctaactttcaaccagaattgtctaggagaggcaaagatataacctgttcatctggtaccactatcacccacagaatatgatatgagttctgagcttttccgattaaagaccttgtacttttg

SEQ ID NO: 362603 - DNA, 260 bp, Homo sapiens
gatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaata

SEQ ID NO: 362604 - DNA, 455 bp, Homo sapiens
taaatttggtaatctataatataaaagttatgagagtggaggcttttttgcttggtcattaatttagcagaattgcttgcagcaaactcttatttaaagattttggtttttataaatataaatgttttatttttaaatgtaggaagatattgatgcagaatcttcattttcattaaatatgaactttagcagtaaaagaacaaaatttaaaattactacatcaatgcagaaagacacaccacaagtaagtgcttttaatgtcaagttttttttgagggggaaacatttaagcattggactttacaagtgtttacattgagattgtgcaaaactttgcacagcaaaattaataatgggatatgtcttttctggtttgttgttggcatttattaaccttacagtcaaacagaaatctctacttgtattttagttttttctaaggaaaagggtatggt

SEQ ID NO: 362605 - DNA, 645 bp, Homo sapiens
tcttaatcctacacagcccatacatcagggaatgagtatgctaaagtatatgttctatgatgtctggatgcgtggccatcttactctaagctcctatcatctacgattagcaaatcccctaggcatccgaatacagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaacaaatggaacagagctagaagtgcagttgatgtgtagaggataacctatggccaacaacaaatagttaggatcatcaaagcacggagagtccctcggcgcgaaccatatagtacaaagatgataagc

SEQ ID NO: 362606 - DNA, 3684 bp, Homo sapiens
accattgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagaaaaaaaaaaaaaaaaaaacaaaaaaaaaaaaaacaacaaaaaaacagaaacataaaacaaaaaagaaaagcaaaaagaaaactaacaaatacaaaacaaactgagagagaaggaggggcgcggcgacataaaatgcgacaccatagtagacgtgggcccacaccggaactataacgcgacaaacacgagtgtatcatgaacactaatagggtgctaccgaacagagtgaattgaaaattaagccagcaccagtatgtgatgctgagctacaacgacagaggcttgagaggataaagatatgagtgaaagaatagcacaacctcagagcgaaagtaaacacaatcaagagccacatgatatgaggcgagagaacaacaaaaacagagaacagaagatagaaccaaatacgaactgagagataacattaccattgaccgtctagccagggacccacaatataacaagagtatagtgagcttagcattgacgctaatcgaggagcgctacagacaccacagaggcacagtgcaattaacacgaaactgcggataagaaacagaaaagaaatataagcctctgacaccaacggcagcagtatccatcgaggcaagaccacagcaaacgaggagagaggatacaaaacgcaaaagaataacagtctgcagataagatccaatacatgtcacggcattcc

SEQ ID NO: 362607 - DNA, 4080 bp, Homo sapiens
atggggagaacaggtcaggcgcagtggcccatgcctgtaaccctagcactttgggaggccaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362608 - DNA, 4539 bp, Homo sapiens
tccctgccgaccccggaccaaaagtagcgctgcagccgaccgaaccgcgtcctcccgccccgtcctcccctcccccacgccgggacggcctcccgggggaggccccgaggaaaaaaatccaggctcgaactccgccccctgccggccgccagcaggagtgaagcgccacaatccaacaatgaaatggaaccggggaggggcggcgggaaggttatagtgccatcatgtggatactttgttttcttcaaataaaatgtaacctttttataacagagactagaaaacccagccatcccaacacccaggatagaggcactctccattcctgattgttccaaggctcaagtggtcagaaatgactgggaagaagggagaaaaactcaggtggcaaaggacatggacgaaaacccatggcgacatggaaagaaaaccctgtgatatagagaggaaaagcacaggacagcttattggggagaatggaactcttctgtatcctgattgcggtgatggccacgcatggctatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362609 - DNA, 4376 bp, Homo sapiens
tgggttccggaccctgccggggcggcggggcgggcaccgcccgagggggtagggcgcgcgcgggggcgcgccgggccggggaggcgcgctcgctccgcgctcccttcgctcgctcgtttcctcctccctcggcagccgcggccgccgccgccgccgcctccgcccaccttcctcgccggggcttcgtctttcactccttcgggctgcctccccctccccttgtcccctgccccttgccctgcttctgcagaagagcgctgacccgtaagccctgccaccccctggactggatcccgggcctccccaacccgatcttggccgcctctcccgcggccccattttccttcgaaggagggaagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctacatgaaaaatgtctagattattgttcttgactgcataggactgcattcagcataaagaatgctttatttttatggattagatatattggatctaaacattttgaatcttgaagatgtaattccatcagcagtttctggtggtgtgctactccacagacatcgcagagtgtgagcaggatgcttggtgacctcaagtctggcacagagagagcttttcattcaaaagttgtctttcttcggttgcataatccattaattctagcatagactagtaccctagctctgtggccttccctgagtcttaggaaatctatgataccaacatattccttctatatgcctcccctacctgttacccttacaaccctcctccaacagtttagatactagagtcactctcatcaatcacagatgtgcttagcaatgcataacctaaatacttttttaaaaaagaaaattgtacattgtactgggtgccacatatataaatcccattattttgtttattttatatatatatatatatataatatatatatatatatatctcaacagcagtgttaagagtactgcgatctattatccatatttattgtctatccacaccatcaccaccaccaccacacccctcctccctcaacatacaatttttctttattttaaaaaaaataagagacggggtttcgccatgtttcccaggctagtctggaacttctggcctcaagcaatcctatctctgtctcccaaagtgctgggattacaagcatgagccactgcatccatccaacacaaaatttttaaaatcggaatattttaaagcaaatcacacaaattatttcacttataatacttcagtaaggcctttaaaaaatccacagtgatattattactcctaacaaaaacaataattacttagtatcatctaatatgtggttcatatttaaatttgttgttttgagatgggtcttacaattggtttattcaattgcattttttctaactcgtgtctcaagtgttttaaaaatctactgaacttataatgacttatataatgtatttctcattttacctttcttccaaaagaggaaataatggcaaaccatataatattgtacattcactgtcaaaaagcaaacccttgttttgataacttgttgattgataaaagttttccaaa

SEQ ID NO: 362610 - DNA, 2752 bp, Homo sapiens
accattgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaaatggagcagactagaagtgcagttgatgaggaccggaaaatgtatctccaagctgctatagttcgtatcatgaaagcacgaaaagtgcttcggcacaatgcccttattcaagaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttaagataacctaataattgtatctacattaaaatgacaaacatgatactgctgcttgtcaaat

SEQ ID NO: 362611 - DNA, 2284 bp, Homo sapiens
accattgctttccgggtggcgggggggatttggcagcagcggaagaaggagaccggagggtgtgtgttgggcaaagccggaggcagaggaggacgattgttttacggatcccgtgatcggcccgtccttctcccctttccccccctccctaccgcccctgtcccgccggggagcggcggcggccttggactttgctgtctttcctcgcggagacagatttcaacactacacttgcacaatgtctttgaaaccaagagtagtagattttgatgaaacatggaacaaacttttgacgacaataaaagccgtggtcatgttggaatacgtcgaaagagcaacatggaatgaccgtttctcagatatctatgctttatgtgtggcctatcctgaaccccttggagaaagactttatacagaaactaagatttttttggaaaatcatgttcggcatttgcataagagagttttggagtcagaagaacaagtacttgttatgtatcataggtactgggaagaatacagcaagggtgcagactatatggactgcttatataggtatctcaacacccagtttattaaaaagaataaattaacagaagcggaccttcagtatggctatggtggtgtagatatgaatgaaccacttatggaaataggagagctagcattggatatgtggaggaaattgatggttgaaccacttcaggccatccttatccgaatgctgctccgagaaatcaaaaatgatcgtggtggagaagacccaaaccagaaagtaatccatggggttattaactcctttgttcatgttgaacagtataagaaaaaattccccttaaagttttatcaggaaatttttgagtctccctttctgactgaaacaggagagtattacaaacaagaagcttcaaatttattacaagaatcaaactgctcacagtatatggaaaaggttctaggtagattaaaagatgaagaaattcgatgtcgaaaatacctacatccaagttcatatactaaggtgattcatgaatgtcaacaacgaatggtagcagaccacttacagtttttacatgcagaatgtcataatataattcgacaagagaaaaaaaatgacatggcaaatatgtacgtcttactccgtgctgtgtccactggtttacctcatatgattcaggagctgcaaaaccacatccatgatgagggccttcgagcaaccagcaaccttactcaggaaaacatgccaacactatttgtggagtcagttttggaagtgcatggtaaatttgttcagcttatcaacactgttttgaatggtgatcagcattttatgagtgcgttggataaggcccttacgtcagttgtaaattacagagaacctaagtctgtttgcaaagcacctgaactgcttgctaagtactgtgacaacttactgaagaagtcagcgaaagggatgacagagaatgaagtggaagacaggctcacgagcttcatcacagtgttcaaatacattgatgacaaggacgtctttcaaaagttctacgcaagaatgctggcaaaacgtttaattcatgggttatccatgtctatggactctgaagaagccatgatcaacaaattaaagcaagcctgtggttatgagtttaccagcaagctacatcggatgtatacagatatgagtgtcagcgctgatctcaacaataagttcaacaattttatcaaaaaccaagacacagtaatagatttgggaattagttttcaaatatatgttctacaggctggtgcgtggcctcttactcaggctccttcatctacgtttgcaattccccaggaattagaaaaaagtgtacagatgtttgaattattttatagccaacatttcagtggaaggaaacttacatggttacattatctgtgtacaggtgaagttaaaatgaactatttgggcaaaccatatgtagccatggttacaacataccaaatggcagttcttcttgcctttaacaacagtgaaactgtcagttataaagagcttcaggacagcactcagatgaatgaaaaggaactgacaaaaacaatcaaatcattacttgatgtgaaaatgattaaccatgattcagaaaaggaagatattgatgcagaatcttcattttcattaaatatgaactttagcagtaaaagaacaaaatttaaaattactacatcaatgcagaaagacacaccacaagaatatgagccaaccttaaattcgttgatgtaggccggttgtttcttccttgttttt

SEQ ID NO: 362612 - DNA, 777 bp, Homo sapiens
tccctgccgaccccggaccaaaagtagcgctgcagccgaccgaaccgcgtcctcccgccccgtcctcccctcccccacgccgggacggcctcccgggggaggccccgaggaaaaaaatccaggctcgaactccgccccctgccggccgccagcaggagtgaagcgccacaatccaacaatgaaatggaaccggggaggggcggcgggaaggttatagtgccatcatgtggatactttgttttcttcaaataaaatgtaacctttttataacagagactagaaaacccagccatcccaacacccaggctgtgcaaagaaattggggccaaacgtttttttgccatgttctgaaaaggatagaggcactctccattcctgattgttccaaggctcaagtggtcagaaatgactgggaagaagggagaaaaactcaggtggcaaaggacatggacgaaaacccatggcgacatggaaagaaaaccctgtgatatagagaggaaaagcacaggacagcttattggggagaatggaactcttctgtatcctgattgcggtgatggccacgcatggcttagagacgggctttcaccacgttgactaagctagtcttgaactcgtgacctcaggtgatccacctgcctcagcctcgctaagtctaactttcaaccagaattgtctaggagaggcaaagatataacctgttcatctggtaccactatcacccacagaatatgatatgagttctgagcttttccgattaaagaccttgtacttttg

SEQ ID NO: 362613 - DNA, 4636 bp, Homo sapiens
atccttgctggacacagtgaaggaggctgtttatgttgtggtactgggagaagcgggggactgtgccgtgtggaacgtgtagctgttgagaggtggactctgttaccattgaggatgtttggaggatgagtatgtgtggcagaggcacacataaacaggcagagaccctttgcccctgcctttctcccccaacccaaggctgacctgtgttctcccaggtctgggattctaagtgacctgctctgtgtttggtctctctcaggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362614 - DNA, 591 bp, Homo sapiens
ccgcccctcttcactgttcctcccttccctccaccttctagctcctgagttttgttttttcattgtcaaggtgattggcagttctgtttctgtctcaccatcacaagtctgggatgtttttcatcacaaggatcagtggccgcagcccatgaacccttccctctgcttcacttcattcctctgccccctctctggtgctgcccggctcagatccctgccttcgccccagggctgcctggttgtgagggctcagctcagcagccctggcaaggtcaccagctggagagtcttcctcactgtagccctgtagccctctgctgccctggccactgaaactgtcctctctctcctgccaaccccagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtacgccagggctcaggggctgagtgaagagggaagccaggaagggggcctggtgtgttccctctgctttctgtccaggacagtcgcaggt

SEQ ID NO: 362615 - DNA, 4287 bp, Homo sapiens
  misc_feature (4)..(4): n is a, c, g, or t
ccantctgcttcctcgtgctcaatatgcaaatctgtcccttttgtgacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362616 - DNA, 4357 bp, Homo sapiens
taaattcctattttttctcctctctgctaatccaactccttttgctttaggtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362617 - DNA, 2852 bp, Homo sapiens
gacccggcatgactcacctgttcctcttcctccccggggcggcctggcagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362618 - DNA, 2583 bp, Homo sapiens
atcaggaaatgagggaaggcaggcctcacctgttgtcttttgccccccagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362619 - DNA, 3037 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccaggtaaggggggcaggtacactctgacgggcagagtcccagaagccaatgca

SEQ ID NO: 362620 - DNA, 2791 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaaggtgagtcggttgtggccccggagccatggctccaggggtgtggttttccc

SEQ ID NO: 362621 - DNA, 2330 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaaggtagaagagccccacgctggctgacccggggggcagaaacagaggtggac

SEQ ID NO: 362622 - DNA, 2015 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggtaaggccccccaccaactgccgtgccccccaatgcattcattcgccaaa

SEQ ID NO: 362623 - DNA, 1480 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtacgccagggctcaggggctgagtgaagagggaagccaggaagggggcctggtgtgttccctctgctttctgtccaggacagtcgcaggt

SEQ ID NO: 362624 - DNA, 475 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacaggtaagcaggggagacaagcctgagtgggaaggtggggactggacccagcc

SEQ ID NO: 362625 - DNA, 405 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtaggggcctagggttgttgtgggcacggggcaggtgggtgggcctgcag

SEQ ID NO: 362626 - DNA, 1049 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctgggcaacatagcgagatcgcatgtctacaaaagagtaaaaaatagaaataaaaaagaaatttcaaaagtctaaaaagatatctgtcaaagggcagttacctctgagaataggactggggaatggagacttttgctttttttggtatcatttgcattcttttataatgagcctatatttgtttgcaattaaaagtaagatcagggccgagcacggtggctcacacctgtaatcccagcactttgggaggctgaggcaggtggatcacaaggtcaggagttcaagaccagcctctggccaagatggtgaaaccccatctctactaaaaatacaaatattagccgggtgtggtggcaggtgcctgtaatcccagctactcaggaggctgaggcagagaattgcttgaacctgggaggcggaggttgcagtgagccaagatcacgccacagcactccagcctgggtgacagagcaagactcagtctcaaaaaa

SEQ ID NO: 362627 - DNA, 4662 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362628 - DNA, 3508 bp, Homo sapiens
tgcacacaggcagcactccagaactttaattaagtacaagaagttgctcctgataccaagggcacgggatacacaatttagcctctgagggtccagcaggccccccaggcccctgcatcaccactggaaacagcagcagcctctgtgtgtggagcactagggtgctgacaggatgccagggacccagctctggtcccctcaccctgtcttaacagctgcctctgggcccttgcaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362629 - DNA, 4076 bp, Homo sapiens
tgtccctgggccctggccctctgtgctgatagctgtgtttccccccgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362630 - DNA, 3773 bp, Homo sapiens
ccgcccctcttcactgttcctcccttccctccaccttctagctcctgagttttgttttttcattgtcaaggtgattggcagttctgtttctgtctcaccatcacaagtctgggatgtttttcatcacaaggatcagtggccgcagcccatgaacccttccctctgcttcacttcattcctctgccccctctctggtgctgcccggctcagatccctgccttcgccccagggctgcctggttgtgagggctcagctcagcagccctggcaaggtcaccagctggagagtcttcctcactgtagccctgtagccctctgctgccctggccactgaaactgtcctctctctcctgccaaccccagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362631 - DNA, 1971 bp, Homo sapiens
  misc_feature (26)..(26): n is a, c, g, or t
ggatcctggagcccagggccctgagnccgtacccaatcctgttgtttcagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362632 - DNA, 1826 bp, Homo sapiens
  misc_feature (15)..(15): n is a, c, g, or t
ttggggagccagcanccgctctcctgactatcaccttgtccgccttctaggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtt

SEQ ID NO: 362633 - DNA, 4712 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtgaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaagcagccttcctgctcggtgcacgatgctgccctgaaacacaggctcagccgttcccaggggatctgccagccccccggctcagcagtgggaccagggcctcgcagcagcaaggtgggggcaagcagaatgcctcccaggatttcacacctgagccctgccccaccctgctgagaaaacactccgccacgtgaagagacagaggaggatggcaggagttacctcgggaaacaaacaggatcttctctgccctgctccagtcgagttggcctgacccgcttggatcagtgaccatttgctggcagacaggggagagcagcttccagcctgggtcagaaggggtgggcgagcccctcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgctccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgtttccaggccatcggtgtcctctctcttgcctgccggcctgctgaacctcac

SEQ ID NO: 362634 - DNA, 2936 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtacagtccaattcccacctgctcagcagtccccgtggcagctgatctgc

SEQ ID NO: 362635 - DNA, 1910 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaaggtaaggcccaggccccacggccctgatccccagcaggctcttctctcaca

SEQ ID NO: 362636 - DNA, 2179 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtaaggagccaggtcccactctttctccaaattcagggccaagagttcccccctgagtcttgcccaagttggccttggtcactgatctatccattgttaacctcttgaccctgtgaccctgctttccactgcctgccctgtgctcttgcccttggctggcatggaggctcgggcaagtcccatgtatagcctggcctttggtctcctaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaaggtcggtgacggcacccagcatggccaacagggggagctgcagggccctgg

SEQ ID NO: 362637 - DNA, 1301 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgaggtaactaatcccccggcacctgtatatgtccctctaccagcaacctgggg

SEQ ID NO: 362638 - DNA, 686 bp, Homo sapiens
cggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggtgagaccctccacccactgcccagaccccaggttcatggggccttgaaa

SEQ ID NO: 362639 - DNA, 1586 bp, Homo sapiens
  misc_feature (617)..(617): n is a, c, g, or t
aaaaaaaaagtaaagggaaacagacatgaacactaggtgacatggagtgttaggggcgctatggtagaagtctgcagagagtgcaatgggcgtccaaatgaggaagtgatcacttgcacaagagtgggaggcttggctggaaaggcttctctgaataggatgacatttgatctgtgttttgaagggcatcgttggcaaggtaagtaatccaattaaaggaggttgcctcagctaaagcacagtatgctcaaaggtgcggatcatttgaaaatttgagttcaggtgcagtaggggtaaggtaagtatccaacagaatttcctacaatgatggaaatgttctatattgtcactgtccaatacggtagcctctagccacatttggccagtacaactgaagaattgaatattaactttcatttaattctagctaatttaaatttaaatagtttcatcagttagtggctaccatattgaacagtgcaggtttagagataaacagaggccagttgcaggagggtcttgcatcccattgaggaggactgaattttcttctgcagggccttctgtggtctgcagaaagggcagtacacaggcagtaatattatcagctttgcctntgggagtgccccagcctggaagcagataatacagttaggagattcccataacctgcctgagtgagagcattagtaattagggaaggaaatggatgtgagacttgctgagaagggctggacaggcttagtgacaggtctgagtgtgaggggagagggagtgggggaagtgggatcaggtttgagccagctattaaatcaatgccaattcatcccataaagaatgcagagagtgggacaggtttggagagtgtaaggaacatggctgtgctgtagccaagcaggcatagggtagcaggaataggccgaggtaaacagcctagacatctcagcgggattggggtgcaagtgcacagtcctgtgtcttatatagtcacagccatgtaggcataacatagagcagctccccacctggctctcagccactagtgtttgtgtagtgtataaatgtaacactgaccctgtgaaggggctgctgaataaagccatgtctcatttacctgctgtctctccagtgttcttccagctccctgccccacatccacccactgtcctcagacctcagctggggctgcaccccaaccctgagtgtgacagagagaagatgagtgttagagatcatgatcctgaagtgctgacgagaaattcaggaagcctgcaagcctagaggtcagctcagtggccaccttctgaagcccagggcaccattggaagctgcctagtttgaggcacggatggaagaggaaaacactgagaacaacatccctcttcctgaggaatgcatacaagggtgcttgggggtgggttggggatcccaaggcaggagagccaaagctggagtcagaggaagctcttcttctgaaacctgtaatttcaatgtcttttcctttcccttcaaaattgtaatttccttctgaaatcattctaaccctttagtaaagacattaatttaaagatgtttaaaaaaaaaac

SEQ ID NO: 362640 - DNA, 3901 bp, Homo sapiens
  misc_feature (1346)..(1346): n is a, c, g, or t
  misc_feature (1547)..(1547): n is a, c, g, or t
  misc_feature (2581)..(2582): n is a, c, g, or t
  misc_feature (3244)..(3244): n is a, c, g, or t
aaattgcttattaagcctcaggtttcttcacttacaaaatgaggataataattgcacctggtccacagggtcatgacatggattcagtagaaagctcagcagtgtacctgacttaacagttgttcacactaagatctttaaactttacaatggtgaaaaggcaatatgcattccatagaactcatacaaccattttgttcttaactttcagtaaaatattcaataaatattcaataaactaattcaaaaaattactttattacaaaataggctttgtgttagaggattttgcccaactgcaagctaatggaagtgttctgagcacattcaaggtaggctaggctgagctgtgatgttcagtggattaggtattaaatgcatttttaacttacaataatttcaacttataatgaatttatcaggacttgatcccgccataagtcaaggagcatctgtacaccaactgttggttattatttttcatccccacaagacagatatagttctgcatttctcatgcagattctacaggcctttattctaattttttaatgtgccaattttatcatatttggtttcttcagtctttaatatattcatgtagatgtctgtgaattatagtctatctatgcttgtaggctttaaaatatatttagtcaatggtgggtagaaattttattttagcttaaaaaattaatcttataaaatgcctgctgacatttcatgtaagaattcttttactcaattcatgtttttctcttcttccctgtggagtatatttattgactgcagatggaagcacattgctaaggaatggaaagctgcaagatagaacatgcccttcacctgcgtggttgcatagaaaccagtcgtttgtccaaatcttaaagaactcaagtggaaagcatacttaaaaatgtaaaggttagaatcacaaactacagtttgaattgaaatgactgaaagattgtttcaagaatataagaattctatctaaaagaagtgaatgaaaggtatattctggtaagtcctttataattatgattttgaacaaactgctttaaattatgctatagcatgaactgagaaggaaaaaagtgaatagaaggatatcaggattgctgaagcacagaacccagaacaacagtccaaaccaatgatggaggtgaaactaagatagcagccacaaccagaagttgattcagaaagaattaattcgggctgggttgtggtcatttatacctgtaatcccagcactttgggaggctaaggcagctggattgcctgagcctaggagtttgagaccagcctgagcaacatgacaaaaccctgattctaccaaaaanaaaaaaaaaaactagcctgtggtggcaagcgcctctagtcccagctactggggaggctgaggtgggaggatggcttgagttcaggcaggggaggttgcagtgagctgaggtccttccactgaactccagtttgggggacagagcgagacactgtctcaagaaagaaagaaagaaagaattggctgggcatggtggctcacncctgtaatcccagcactttgggaggccaatgcaggtggattgcttgaggacaggagttcaagaccagcctggccaacatggcgaaaccccatctctactaaaaatacaaaacttagctgggcatggtggcccgggcctgtaatcccagctacttgggaggctgagacaggcgaatcacttgaacccaggatgtggaggttgcagtgagcccagactgccactgcattccagcctgggagaaagaaaaaaagaaagaaagggagggagggaaggagtcaggaaggaaggaaggaagggattgattcagagacaaaacagaaatagaccttgtttttcgtgattaaaatatgctaaaagcaatagctaagattgcagctgaagagtatgaatataatagtagcccacaaaataccacagcattgtggttgttgctgtcgttggtcttagtctttgtctctatcttggttttggtatagatattattgtttgcaaggtactaaactagctcattataaatttcaggttaaaaaataagcagcaaggatatctggagacattctgacaataaatgcaatgatagagcactagccttttcactatagaccaatagaaatggaagcagtagttgtggggcatgaatatacagacacaagaatcagtggcacagaatagaatttccagaaacagataccaatgcacttatgcatttgttaatttagtatatgacaaagatcgctgctgtggtttgtatgtgtccctcagatttcatgtgttggcaacttaatccccaatgtgatagcattgaagggtgaggcctttaagaggagattggggctgggcacggtggctcacatttgtaataccagaactttgagaggctgaggcgggtggatcacttgaggtcaggagtttgatatcagcctggccaacatagagaaaccccgtctctactaaatatacaaaaattaactgggcatggtgaccacacctgtaatgccagctacttgggaggctgaggcaggagaatcgcttgnnctgaggaggtggaggttgcagtgagctgagatcgccccactgcactccagtctgggtgacagaatgacactccatctcaaaaaaaaaaaaaaaaaaggacaggaagaatgatctgagctagcatagtcagcacattcagcccacttcctattgtgaagcccctgtagagaaccccccccaacccgcaagaaggctctcacctgctgtggcccctcaaccttggacttctagtttgaggtattctgttataagcaacagaaaacaaactaatataatggcatttcaaagtagtggaaaaaaacatgacattcagttaatggtttgaaggcaactggagagttattgaggtgaaatattattgaatcctctcttataatacatcaaaatatattccaagtagatcaaagtttacaagtaaaaataaaactgcaaaagtatgaaaagaagtcatgtaagaatttttacataaatcagattgaggaagaccttctatttttaacacaaaacccaggggtgaaacagtattaataaaaaattgatgacttcaacttcataaaaatttgtttaaagcttctaggtcaaaaatcataggcttcggtggaatattgctgtaaaagaaattttttaaaaacagaaaaaagaaagaaaaactacaggcaagntcaaaagataaaccacaaacctgagaaaaatatttgcgtctcctatcacagacaaaggacttatttcttgactatataaggaactcttaagcatcaataagaaatagattaacaacactataggaaagtagattaaaattttacatagaaaatataaaaataactaaacatcattgaaatataggaaagatttctcaatcactcaaaataaatgcaaattaaaactacactgagaagactttttaaaatctatgagactggcaaaaataataaaattataaaactgtcttggtgaaagtatggaattcaatttggcaatatctttggcatatatatatcttttgccccagaaattccacttccgggaatttatcctacagatactcttgtacatgcagaataacatatggactagattgtcattatggtattatctgttaaaaaaaaaaaaaggaccaaacaatctaaatataactggttacataaattatgatacagctttccagtggaataataagcttctattaaaaaaagagaatgggctgggtacaatggctcatgcctatgatcccagcactttggaaggctgggaggattgcttgagcccaggactttgagaagaccagcctgactaacatagggatatcctgtctctac

SEQ ID NO: 362641 - DNA, 1885 bp, Homo sapiens
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccagggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatggaactaaataaaatctttactactgagcccc

SEQ ID NO: 362642 - DNA, 2461 bp, Homo sapiens
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccagggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatggaactaaataaaatctttactactgagccccaaatatgtatttgctatgcctgtctgtataatgtacttcatatagtttaaaatgcacttcagtgatacaaaatcccttttaaagactcttttgtttttgttttccctgtgtattttggctatcacaaaactagggttcttctgtttttaacttatgcatttaatgacacattgccatcttttagaattttttactattcaacagaataagctgatgtttggtggcagaggagttattagttgcgtgaactgtcaagagattgcagtgcaggagggcaacagaaactgtacaaggtgcagacttgagtcatgtaagatctatgtgaatgaaccaaagtaactagagtcagtcaagcacaaagctgtgaaaagtagtgtgtggaaagaatcatactgaattttaggaacaagtacctgactatgatactttttacagagtggctacaagttgtaggacagtctttgtgtgtgctgagtgtcaacagctgcctgcctatgtgttgatgttttcatcctttctttgttgaatgagggtataaccatcaaaaataaaatacctttcaaatagtccaaagat

SEQ ID NO: 362643 - DNA, 2131 bp, Homo sapiens
ctcccccgcccctctccctacctcccgctcctcccttcgcttccgctcccgactccccctgtcatccgcccctgtcacgcctacactcccccacttatcacgtccctcacctccgccaccgcgctatcccaccccgccccgccttgttccatgcacacacgcctcgcacacacgcccaatccgttctctagccccctcgggaataccccgggggaaatccacgatattcgtgcccacacgccgctttcctgttctctcccctcgccagcgagggttttttccacacccgcctgcaccctaagccccagtccctttcttaattaccaccgctacagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccagggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatggaactaaataaaatctttactactgagcccc

SEQ ID NO: 362644 - DNA, 915 bp, Homo sapiens
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaatgcgatgcggcaagctttctttttccttgaatacgtcaactatagtaatccagcgtga

SEQ ID NO: 362645 - DNA, 754 bp, Homo sapiens
  misc_feature (698)..(698): n is a, c, g, or t
  misc_feature (701)..(701): n is a, c, g, or t
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaanccnatgcggccagtcttttctcctatttgtttatcacacatagatttaaacattcg

SEQ ID NO: 362646 - DNA, 855 bp, Homo sapiens
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaaatgtgcaaaaaaaaaaaaaaaaaaaaaaaattggggggcggggcggaaagttttaaacatttgttgggggggcccagttggaagggaaaggcaagaacggcgaagggggtcccaaaaacggggcgggttgaaaaagggtggggggttaaggaggtggg

SEQ ID NO: 362647 - DNA, 774 bp, Homo sapiens
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaacactgtcgaaagtactgggttggattggcaggaggttgtctccgggtaaactttttcgagcaatagcaatcagggga

SEQ ID NO: 362648 - DNA, 1654 bp, Homo sapiens
aaattgcttattaagcctcaggtttcttcacttacaaaatgaggataataattgcacctggtccacagggtcatgacatggattcagtagaaagctcagcagtgtacctgacttaacagttgttcacactaagatctttaaactttacaatggtgaaaaggcaatatgcattccatagaactcatacaaccattttgttcttaactttcagtaaaatattcaataaatattcaataaactaattcaaaaaattactttattacaaaataggctttgtgttagaggattttgcccaactgcaagctaatggaagtgttctgagcacattcaaggtaggctaggctgagctgtgatgttcagtggattaggtattaaatgcatttttaacttacaataatttcaacttataatgaatttatcaggacttgatcccgccataagtcaaggagcatctgtacaccaactgttggttattatttttcatccccacaagacagatatagttctgcatttctcatgcagattctacaggcctttattctaattttttaatgtgccaattttatcatatttggtttcttcagtctttaatatattcatgtagatgtctgtgaattatagtctatctatgcttgtaggctttaaaatatatttagtcaatggtgggtagaaattttattttagcttaaaaaattaatcttataaaatgcctgctgacatttcatgtaagaattcttttactcaattcatgtttttctcttcttccctgtggagtatatttattgactgcagatggaagcacattgctaaggaatggaaagctgcaagatagaacatgcccttcacctgcgtggttgcatagaaaccagtcgtttgtccaaatcttaaagaactcaagtggaaagcatacttaaaaatgtaaaggttagaatcacaaactacagtttgaattgaaatgactgaaagattgtttcaagaatataagaattctatctaaaagaagtgaatgaaaggtatattctggctggagtgcaatggcgcgatctcagctcaccgcaacctccacctcccggcttcagcagtgtatgtatgaggaagtgcccacaggagtgtgcctccgggatgaagcaaagcaacagagatccaagcaggagaggctgcaacaggctggagatatgcagagtcttcatgggggagtgttcttccagctccctgccccacatccacccactgtcctcagacctcagctggggctgcaccccaaccctgagtgtgacagagagaagatgagtgttagagatcatgatcctgaagtgctgacgagaaattcaggaagcctgcaagcctagaggtcagctcagtggccaccttctgaagcccagggcaccattggaagctgcctagtttgaggcacggatggaagaggaaaacactgagaacaacatccctcttcctgaggaatgcatacaagggtgcttgggggtgggttggggatcccaaggcaggagagccaaagctggagtcagaggaagctcttcttctgaaacctgtaatttcaatgtcttttcctttcccttcaaaattgtaatttccttctgaaatcattctaaccctttagtaaagacattaatttaaagatgtttaaaaaaaaaac

SEQ ID NO: 362649 - DNA, 1289 bp, Homo sapiens
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctgaactttccatcttacctactttttggactttaagaccataaaggacttcctctgctgaggacccaaactgaaccccaaggccagacagtattcttgatataccactgtatgctgcacagtatatttattgactgcagatggaagcacattgctaaggaatggaaagctgcaagatagaacatgcccttcacctgcgtggttgcatagaaaccagtcgtttgtccaaatcttaaagaactcaagtggaaagcatacttaaaaatgtaaaggttagaatcacaaactacagtttgaattgaaatgactgaaagattgtttcaagaatataagaattctatctaaaagaagtgaatgaaaggtatattctggctggagtgcaatggcgcgatctcagctcaccgcaacctccacctcccggcttcaggtgattctcctgcctcagcctcctgagtagctgggattacagcagtgtatgtatgaggaagtgcccacaggagtgtgcctccgggatgaagcaaagcaacagagatccaagcaggagaggctgcaacaggctggagatatgcagagtcttcatgggggagtgttcttccagctccctgccccacatccacccactgtcctcagacctcagctggggctgcaccccaaccctgagtgtgacagagagaagatgagtgttagagatcatgatcctgaagtgctgacgagaaattcaggaagcctgcaagcctagaggtcagctcagtggccaccttctgaagcccagggcaccattggaagctgcctagtttgaggcacggatggaagaggaaaacactgagaacaacatccctcttcctgaggaatgcatacaagggtgcttgggggtgggttggggatcccaaggcaggagagccaaagctggagtcagaggaagctcttcttctgaaacctgtaatttcaatgtcttttcctttcccttcaaaattgtaatttccttctgaaatcattctaaccctttagtaaagacattaatttaaagatgtttaaaaaaaaaac

SEQ ID NO: 362650 - DNA, 304 bp, Homo sapiens
ataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctgtaagaaatacatccaggataagactttgtgtttaatccaaccagactgtcagaaagttctaattttcttgtatttgattttatcatggaaattttatgttgacaagtaagacctctctgtgaataaaagcaggtggaaggacgattgt

SEQ ID NO: 362651 - DNA, 407 bp, Homo sapiens
aaaagcaggaaaacaacctttgcccaccacttttattttgagatgaaaattaaaataatgaacaaaattaacaaattaaagttaaagcaccatttacaaagtacattatacaaagtaataagataactgacaatcacatttggtatgtatctgggttggaattcaaagaaggaatttaagaattactttttaaagaaatttatcagagaagcacaattatgaagggaaaaaatatattattttgtttttagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaac

SEQ ID NO: 362652 - DNA, 2119 bp, Homo sapiens
  misc_feature (314)..(314): n is a, c, g, or t
  misc_feature (318)..(318): n is a, c, g, or t
ctctcagccatcctcaccagctcttccctctcctcccccttcccctcttctgcgaccggctaccgcttgcccaccaccccgcccccgcacccccctcccgccctggccgcacctcactgccctgccactacccccatcctggttccccatcgcaattgcacccggctaaatcctcacaacgtctttgcacgccatggaataccccccgtggcatcccagacttttttgcccaaaagccctcccatgttatatgctaggcgggcagggctttgcaccacagttcgaacataaccggcattactttttaattaccnccgntccagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccagggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatggaactaaataaaatctttactactgagcccc

SEQ ID NO: 362653 - DNA, 777 bp, Homo sapiens
tcgggagcgcgcactgtgtggtaccgggaatcggccattatggcggggcggggcgtctcgggcgaggagaggaggtgaccccgcgaaagataataaatcatcattgatcaagatgtcttcagcacctgagcctccaacattcaaaaaggaaccacccaaagaaaaagagtttcaaagcccagggctcagaggggtgcgcacaacaaccttatttcgtgctgtgaatccagagctcttcattaaacctaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccagggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatggaactaaataaaatctttactactgagcccc

SEQ ID NO: 362654 - DNA, 214 bp, Homo sapiens
acttgaaagattgtcccctaccgtctgggagcaagggcataaacatataaataaataatatacagttcagatggaaaagatacagtacaaagataaggtactaaggcagccccaaggaaggagacacctgtttatctgggggaagatagctctaatcgaggaagacttcacatagctgtcttagtcttaaaagatgaaaaaaaatttgtcaaaa

SEQ ID NO: 362655 - DNA, 2215 bp, Homo sapiens
  misc_feature (725)..(725): n is a, c, g, or t
  misc_feature (744)..(744): n is a, c, g, or t
  misc_feature (753)..(753): n is a, c, g, or t
actgctagctcaagtaaatagtttgttcaaatggccttcgtttctcatactcattgtacaaagggtctgtaaactaggacagtcttagtgatgataaggctatgcaggcaactctgtcacagccaagaggcctttgattgcttgactttcatattcttaaaggaggactggagctgtagcttcttgattctctgtaaagccatatgacctcgagctattttccccctcctgaaatcagtggtgttgagttccatgttaaagggtttatgtgtggcagttggagtgtgatatcaggagttagggccatagggttgctggttctctctatccttggacaagtgactgcctgtctcccagcctccatttgcctatgtgatgagtggggggatcttctatttatgaatggtgagacaagaaaccctgtatggtgggagctttggaaatacagcatttcaggagttcttcagtaggggttcagtctgctagctcacaaaaagactggaaacatgatcattggagctcccggctctggagatgcagagtagctcagggccggggagtggggaggtagcaggatgtattctacggcccagaactgccacagcaaatgctctttttgcattttgaatgaaataagagggattctggaattttcattgatttagggtggtttatggtcagtattgaactgctcagcttcaggaaacctggttctttcagtacantgtccattgctacatacgngtttatttnattctctgcttctgatgattgtagcctgaagtataatgcatttttttcctttggggtttattaaacatgacttctttgcttcattagaatgtagaaattagttgtttccctaaaaccttctgaaggaggcagtcagctacttttcccttacagagttaattttcttcagctgctaaactccatgacactcgtgatgagtcctcaaatcttagtaaaattgggtacaaagaatcaggaaatatatatagtaagtaacaattgtaccaaaaattataatgggccatggaattgcttcatattgaaattataaataatctgtaatgctattaatactagaataatggtagcgcttctcatcttcagggtgcctcgtgagattaaccatggtggttatgctggtgacgtgtttacataaaacctgtgctttctgaatgtgtgttgcagtcttaacattcttgaaatctttgcagaccagttctcaagatgggataggaaagctggactctaggttaccaagtgaaatcggcccgactcctcctgtgttgagactagtcatctactgttccttccattgagacagaactgttgcctgtgtttttactagtcctgttgaatgcaatggatggtattttgaattcctgggttaaaaacagaattgaaaatctgaaatgcctttacagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggtaaaaacaggagctaagaccatttttttccactttaagaaattccttcattttttttttctccaataaggagtaggccacagtctattgccttttctcatgacagattcaaagtttgaagtcatccatgttgtcctatattgcctttcccatatgggcaatgcctcccttctgccccagaaatgggccctgggcccaaccctggtaattggtagggagcagctcttccctggctgtgggcatggtctggtgatgttctccaccccagcctgctcttgatagagcactatagcagaaaatatgaaagtagaccctgaattctgttctagagggactcccaagagaaaacacaaaactagtctttaggtggtgttgattttcccatctcattccagtattcagtttgccttgttctgctgcagccatccttaaaagactgaccgtttaaaaggattttttgacaatgaattgtaaatcctttcttggtcaccaatgtgcatgactgctaaatagaatacaaagtccttattcaattcattgtgcccactctgtaatgcttttctatttaattacattaaactgcattttctgttagtatcccagtcacatatttaaga

SEQ ID NO: 362656 - DNA, 7224 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362657 - DNA, 7012 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcgaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362658 - DNA, 7366 bp, Homo sapiens
acggcagcggccgcggccggaggagcaatagcagcagccgtggcggccacggggcggggcgcggcggtcggtgaccgcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362659 - DNA, 7315 bp, Homo sapiens
acggcagcggccgcggccggaggagcaatagcagcagccgtggcggccacggggcggggcgcggcggtcggtgaccgcggccggggctgcaggcggcggagcggctggtgagccaggagtttggtagcaggtgtccagctgaagacttggtgacagagtctatttaaatgtaagaacatggctgattatttcttatagaaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362660 - DNA, 5247 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgc

SEQ ID NO: 362661 - DNA, 7149 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362662 - DNA, 7132 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362663 - DNA, 7068 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362664 - DNA, 5149 bp, Homo sapiens
gcggccgctccaacatcagaatgggcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362665 - DNA, 7333 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgagcctcccagtttgattttctaggacttgacagaattcgagttatccttctcagaacatgtgcagagtctctttttgcctcaccatgtggtcctgtgctctttcaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362666 - DNA, 5193 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggtaaaaacaggagctaagaccatttttttccactttaagaaattccttcattttttttttctccaataaggagtaggccacagtctattgccttttctcatgacagattcaaagtttgaagtcatccatgttgtcctatattgcctttcccatatgggcaatgcctcccttctgccccagaaatgggccctgggcccaaccctggtaattggtagggagcagctcttccctggctgtgggcatggtctggtgatgttctccaccccagcctgctcttgatagagcactatagcagaaaatatgaaagtagaccctgaattctgttctagagggactcccaagagaaaacacaaaactagtctttaggtggtgttgattttcccatctcattccagtattcagtttgccttgttctgctgcagccatccttaaaagactgaccgtttaaaaggattttttgacaatgaattgtaaatcctttcttggtcaccaatgtgcatgactgctaaatagaatacaaagtccttattcaattcattgtgcccactctgtaatgcttttctatttaattacattaaactgcattttctgttagtatcccagtcacatatttaaga

SEQ ID NO: 362667 - DNA, 7335 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaactacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362668 - DNA, 1300 bp, Homo sapiens
atggcttgatctcagctcactgcaacctctacctcctgggttcaagcaattatcctgcctcagcctcccgagtaactgggattacaggcgccaccaccacactcggctaattttttgtatttttaatggacacagggtttcgccatgttggccaggttgatcttgaactcctgacctcaggtgatccacccaccttggcctcccaaagttgctgggattacaggtgtgagccaccgcgcccggctggcttctgaaattttgagcagttaaccaaatgtaatgttttgatgcaccataagacctttctgtcttacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggtaaaaacaggagctaagaccatttttttccactttaagaaattccttcattttttttttctccaataaggagtaggccacagtctattgccttttctcatgacagattcaaagtttgaagtcatccatgttgtcctatattgcctttcccatatgggcaatgcctcccttctgccccagaaatgggccctgggcccaaccctggtaattggtagggagcagctcttccctggctgtgggcatggtctggtgatgttctccaccccagcctgctcttgatagagcactatagcagaaaatatgaaagtagaccctgaattctgttctagagggactcccaagagaaaacacaaaactagtctttaggtggtgttgattttcccatctcattccagtattcagtttgccttgttctgctgcagccatccttaaaagactgaccgtttaaaaggattttttgacaatgaattgtaaatcctttcttggtcaccaatgtgcatgactgctaaatagaatacaaagtccttattcaattcattgtgcccactctgtaatgcttttctatttaattacattaaactgcattttctgttagtatcccagtcacatatttaaga

SEQ ID NO: 362669 - DNA, 383 bp, Homo sapiens
taccttgagcgtccagtggagaagaaaggtttttgaagaaaacaacacatgtaaatgtgtttcaggacttttgttaaaacctgcagtgattctactacagtggttctcaaacattaacatgcatgtctgtgcattagaatcacctgggaagcttaaaaacaaaccagttaaggcctaggctctcccacagatagagtgattttattgctctgtagtgaggctggttttggttttctttaagctcccaactatcataaactgtctttttaaaacttctttatggatgcattttataccttaatgaaaagtttttagaaaataattgaagtatatttttggaatgtaggtttataatgatgcacatatcctggagaagttactca

SEQ ID NO: 362670 - DNA, 449 bp, Homo sapiens
attgccgtgtgccatgaactctataataccatccgagactataaggatgaacagggcagacttctctgtgagctcttcattagggcaccaaagcgaaggtgagttcgaagcacatcagtacagttgcgggggatttggtccagagtccatgtgtattaaagtgtttggaaattgagctttttgttggcaggaatggcttaaatgatactggggtccaattttagtctttagtctttagtaatcaagctgtagtgaagctttttttaaattaaaaatctgttgagccaggcacagtaacatgcacctataatcccagctacttgattttttgagccaggcacaggagcatgcacttgtaatcccagctacatgggagactaaggcaagagaattgcttgatccaaggagtatgacaccagcctgggcaacataatgagaccccgtctctt

SEQ ID NO: 362671 - DNA, 485 bp, Homo sapiens
caattaaagaagcatttaatagaatttaacatataattgaggtgtttaaaagaaacagcttgtatgtcaatggatactcttgatgctgttataggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagaggttggtttcttttcattttattgaatatgaaaaaatgcactgtcttctagctgttctcataattagctgtggaaaagagtcctgtttgtatgaatgaaaactcagggtattgactatattagagtagacgcaatgagatggaaatatttttatagttatcaatttggtcatcagacctg

SEQ ID NO: 362672 - DNA, 7073 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362673 - DNA, 7129 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362674 - DNA, 7434 bp, Homo sapiens
gtcgcccatatttgattttgagctccaaaatggaagattggaaaatatgttttgaagagcttgccaacacttggtgtcacatgtgagcctcccacatgtattcactctccattccagctctgtgattgaactctgctcttattgactagggggcagttgggcaggcatgcctcattcctggaattgacagtcattcctaatttttgaatatactaacactgaatcagcacttctaaagcccttccttctcccactggcttcacttggctttcagacataatgaggagactggcttttcgaggcgctggttgtgctctgaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362675 - DNA, 7317 bp, Homo sapiens
gtcgcccatatttgattttgagctccaaaatggaagattggaaaatatgttttgaagagcttgccaacacttggtgtcacatgtgagcctcccacatgtattcactctccattccagctctgtgattgaactctgctcttattgactagggggcagttgggcaggcatgcctcattcctggaattgacagtcattcctaataagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362676 - DNA, 7170 bp, Homo sapiens
acggcagcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaactacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362677 - DNA, 3243 bp, Homo sapiens
tatagaggatcctcgaattatcatcctgcttgaatgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggtgtgatgaaccaaggagtggcccctatggtagggactccagcaccaggtggaagtccatatggacaacaggtgagcctcccagtttgattttctaggacttgacagaattcgagttatccttctcagaacatgtgcagagtctctttttgcctcaccatgtggtcctgtgctctttcaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttc

SEQ ID NO: 362678 - DNA, 517 bp, Homo sapiens
gtagattttacatgaagatattcccgtttccgacgaaattctcaaatctatgcaaatatcctcatgcagattctacaaaaagagtgtttcaaaactgctctatgaaaagacatgttcaactccgttacttgagtacacacaacacagacaagtttctgagaatgcttctgtctagttttcatgggatgatatatcctttttcaaaataggcctcaaagtgctccaaatgtccacttccagatactacaaaaagagtgtttcaaacctgctctatgaaaggaaggttcaactctgtgacttgcatggaaacgtcacaaagaagtttctgagaatgcttctgtctactttttaaacgaagatattcccatttccaacgaaatcctcaaagctatgcaaacatccacttgcagattctacaaaaagagtgattcaaaactgctctatcaaaagaaaggttcaactctgttagttgagtacaaacatgacaaacaagtttctgagaatgattctgtctagt

SEQ ID NO: 362679 - DNA, 1423 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattcaaaaaaaaaaacaacaacaaacgagcaaacaaag

SEQ ID NO: 362680 - DNA, 1656 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaaaaaaaaaaaaaaaaaaaaaaaaaaaaaaaaaaaaaaaaaaaaaaataagaattcataaatgctatttttaaatagaaaacatccaatacaaaaccatgtgccttgaccaaacaaagcctttaaatgccaaaatgcaaatcgagccgaaaaattatgtggggggtccctaggcccaattccccttatgggggggattaaaaaattccatggccttgatctttataacccttggctgtgtaaaaccttggtgcacccccaataaattccgtttagccaacagacctttatataccctgttgaattaaattcaaaaacctccacgcttaagccccaattcccaaaatccttggactccccaaattgtttaactaattttgtagggcctcaccctcatattttttattctccaccattgcccctcaaacggtaa

SEQ ID NO: 362681 - DNA, 1300 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362682 - DNA, 1320 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362683 - DNA, 1312 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362684 - DNA, 1284 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctggcacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362685 - DNA, 895 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaaggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362686 - DNA, 851 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362687 - DNA, 886 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattcaaagcccaaaaaaaaaaaaaggggggggcccaaaat

SEQ ID NO: 362688 - DNA, 1390 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362689 - DNA, 1425 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattcaaagcccaaaaaaaaaaaaaggggggggcccaaaat

SEQ ID NO: 362690 - DNA, 2105 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaaggtgagggggtctggggtcctgggaccgctccatggggcacaggggcctgagatggtgggtctctgcttcctgggcctgcatggaaggaacagacttcatctctcaaaccatgctctctaagaaggcatcggaagtgacctagtgagaataaggacgggtggggtgaggaagggctgctcagacagagcccaggaggagcaggaggcggccatcagcagggccggtgcatggtggtgcagcaactctgccccggctctctcagaacagtcctcactgaccatatgtgctgggagaggctgggtgcagggacagagggacggctgagaatgtgccatgctggcttccgctgtgtgataaggggccagtccagtgaccacagggcttgacttgggctgcccctttccagggtatttatgtcacacgggtgtctgaaggaggccctgctgaaatcgctgggctgcagattggagacaagatcatgcaggtaacaggtgtcccaaaggaggagaaataaggtttgggcaagcaggtctgaagcacttgggggtggggagctgccccagcctcccagctgggagagactcactgcagccaattgggaacccatactggcattgccccagaggacgctggctttctctcctgtgtgtctcagccacagtgcttggtgtctcccagccctgggatgttaggctgggggcctacttgaatgacctgggcccccaaagccctctgcttccagatcccagagggcggggagctgaggtgagcctgtgttctctcctggggccaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362691 - DNA, 1512 bp, Homo sapiens
gtgagacgggcttcccacctacagaagccacagcacctggactcttgggccagcaggggcttccaccacatgttgaccaagactagtgcctaagactaacaggggaagtggggacaggttgaggacacagggctgtgtgggtggatcaatgtggccaagttctgagtgccagctcctcagcctcccaggctggtgagcagctggattcctgcaggggcctgggacccagccccttgtcatggctctgaggctgctgctgggaacacccaccagcctaattctccaaccacccacttctctcaactggcttttttctttgccagcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362692 - DNA, 1484 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcagcgtgaaacgggctggggaaccatggaacccatgggttcaacaccacggaaccaggccccggcaaacgcggcttacacacagcgcgcctcgaagagcagtgtgtggcgctgctcgtgtcgtgtggtagcacgcgcgagatctcgtgtcgacgaaaagcgccgcgcagccacgacagcctccgctggctgctcactagagcagcacaacccaccattgctgacgaacttccgtgaccgtgccgaccatcttactgctacaagataacggcacactttatccaacactcttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattca

SEQ ID NO: 362693 - DNA, 1042 bp, Homo sapiens
aagcggaggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccaagtgggaatgcggggaacagcttccgttgctggtgggtcgtcgcctgccccgcttttggccccgtgccttgcctgggtggcccctgcgagggattgccaaacgggcctcctcccccggggggccggggttgtaagggggcccaccgggggtccggggtgtcacggggtgttc

SEQ ID NO: 362694 - DNA, 5915 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcaacgtccgtccggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttccttttcggctttctttggattatttacatcttttgtccagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362695 - DNA, 1618 bp, Homo sapiens
gcctgtaatcccagcactttgggaggccaaggtgggaggatcacttgaggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362696 - DNA, 554 bp, Homo sapiens
tccagcgcagctgcacttgtatttatcctatcagtctccagagcctcctcaacccagttgtctttcctcctcaactgtggtctttagtccctcttttaatttatcctttgatccttgtatgtcctagattcagaggatgatttctaaatttctatagccatagatggagcatattggtggtatattgcaccagaacaaaaagggaagcgtgtgaagggagaaaggaaaaaaaatagaagtaaaagaaacacatgggagagatggaaagaagaacaaatatgagttgaggagagggaggtggagcaaaaaggtaaaacacatataatgaaggaaaatagtatgtttgtcacctgaagttgcattacttaattttttttttttttaagagacttagagacggagtctggctctgtcacccaggctggagtgcagtggcacgatctcggctcactgcaagctctgcctcccgggttcacgccattctcctgcctcagcctcccgagtagctgggactacaggtgcctgccaccacacccggataacacgttcgcgat

SEQ ID NO: 362697 - DNA, 406 bp, Homo sapiens
atgtaaggtttataattctttcttccttggaacatgaaatataagtaatatacttgaaagagactaaactctttggagaaaaatgtgcagtgtttgttcacttaatcttgccacaggcaaacctaggtaatggactaagtggtagattgaagggctattgcgttttagtcttgattgataacacttaatggtatttgtttatctttgagcaagtcacttaatctgccagggcctccgttttcatatgtcataataataatgaaacctctcattacagtttttcagaacacttcccatacattcccatttgatcatcaccacagtcctgtgaggtatgcatggcagatactactgtcctcattttactgatgaggaaactgaaactcagaggttgaatgacttgccc

SEQ ID NO: 362698 - DNA, 367 bp, Homo sapiens
ggtagaggtggaggtggagaaaggacgtttcaagggtgaagcttcttcagtaaacactgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggtataactacttgaattgttccacttcccatctaccagatttggagttggttgtcatcaatgaattgctagaactctcacattgatcattcacaggttatcttgttatcctgtc

SEQ ID NO: 362699 - DNA, 6136 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcaacgtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttccttttcggctttctttggattatttacatcttttgtccagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362700 - DNA, 5241 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcaacgtccgtccgtggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttccttttcggctttctttggattatttacatcttttgtccagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362701 - DNA, 409 bp, Homo sapiens
gctgactagaagcaagttgagaaggcgggctgtggttgttgaggtgttaagggtaaacataaacttagaagaaccaggtgcttttatattttgacagctgggaaagacatagaagaactattaagaagatagaattgttttgctgcgcagtacagcaacagtggatgttcaagattaagattagagtcaagttgtgtgattaagacaggtaagtgtgtagtttagtttcaattagaaatggttaaatataaaattatttttgcctgaaagggtagaccttgaaactttggaaaactgactggtggaacaccttcgaacccaaccaccctggatgaataaggtgttagtttttaatttctgtgtatttttcagatagatgcagatttctttttttaaaaaaacatgctca

SEQ ID NO: 362702 - DNA, 467 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcaacgtccgtccgccccgtgactggctgcagtttccgctgcgtttcagctgagctgccgcaggcggccaccgccgccgcccggacgccgggaccgtttcaccctcagcgcccctggccctgcgccttcccccgcgcctgtagccacccgagggcagtcggggcaggtggcattccggacacctgggcttaccagggcatacgggaccccaggaaatgttatttttgcttaagtcaaatcatatgtggctgctaaggtgctttcgatgcagttgtttttccaacaatctttgccgccccgagtatctgaataaaggaagaaaaataaaga

SEQ ID NO: 362703 - DNA, 6264 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcaacgtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacagacagtcttcctctgtcatccaggctggaatgcagtgcagtggtgcaaatttggctcactgcagcctctgccttctgtgttcaagtgattcttcttctgcctcagcctctcgagtagctgggattacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttccttttcggctttctttggattatttacatcttttgtccagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362704 - DNA, 6153 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcaacgtccgtccggagctgtgactgatgagaattaaaggccatggatgaagatgggcttgaattacaacaagagccaaactcattttttgatgcaacagtttttcagaacacttcccatacattcccatttgatcatcaccacagtcctgtgagattcagaggatgatttctaaatttctatagccatagatggagcatattggtggtatattgcaccagaacaaaaagggaagcgtgtgaagggagaaaggaaaaaaaatagaagtaaaagaaacacatgggagagatggaaagaagaacaaatatgagttgaggagagggaggtggagcaaaaaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttccttttcggctttctttggattatttacatcttttgtccagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362705 - DNA, 6026 bp, Homo sapiens
cggggagctgggccgctttttgtcagctccgagctcggcccctcctccctccctccgcccgccccaccagccggagcccggcccagtgctccagagaaaggccggcctgcagcacccgccaccgtcgccggccgcccgcaacgtccgtccgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttccttttcggctttctttggattatttacatcttttgtccagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362706 - DNA, 5988 bp, Homo sapiens
tccagcgcagctgcacttgtatttatcctatcagtctccagagcctcctcaacccagttgtctttcctcctcaactgtggtctttagtccctcttttaatttatcctttgatccttgtatgtcctagattcagaggatgatttctaaatttctatagccatagatggagcatattggtggtatattgcaccagaacaaaaagggaagcgtgtgaagggagaaaggaaaaaaaatagaagtaaaagaaacacatgggagagatggaaagaagaacaaatatgagttgaggagagggaggtggagcaaaaaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttccttttcggctttctttggattatttacatcttttgtccagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgtttttttttttttttttttaaaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactctggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggattattttcatccccccatttcttaatttctttttcacagcagtggaatgcaaagtgcttgattgctttgaattttgtgactcggatgcaaatactggtaatatttcagttctgtgaatttgcaagtaatatttcagagaagttaagaggtgattggtgagtcctttgatgagcatgtccttgga

SEQ ID NO: 362707 - DNA, 327 bp, Homo sapiens
cagctgaattctcagcagccacattggagccagggatggcacagtgcaggaccttgagaatgtccttatcctgtagcacaaaggattagctgccacttcccaacagattggctacttggtcatggtggtttgcagccagatgatgatgtagccattaagagtgagtgccattgtacgattcctgatactagtgttgagacatgaaattttcctgctctgtaagcaaacaatattgaacataaaaagtgacacataatactctagaagcttaaatgttgtcccaatcacttttctctacatttcagcatgattgcctgtatatatttt

SEQ ID NO: 362708 - DNA, 398 bp, Homo sapiens
gaagaataatatgtgaaaatagcagagtaataaataagaatacatttgtgaacctatgttatgtttcagacactatactaggcactttgtaagttgtttaattttcacaacaactgtacgagacaagttaaagataaggaaacaggctcatggagaacaaattcctttcccagagttagaaagcctctgattcaataccaggaccatcttgttccaaagcctttttctactacactatacctccctaagatttattcagaatttgtttttattttaaaatgaggtgggtgcagtggcacactcctgtaatcccagcaactcagtaggctgaggcaggaggatttcttgggcccaggagttcatgaccagcctgggcaacaaagaaagaccctgtttcc

SEQ ID NO: 362709 - DNA, 731 bp, Homo sapiens
aagaaaaaaggagaaaaaaaaacaggggtgtgggcgccaggactgaagaatgaggtgtgtgtgtgttggggagtgtagttgtggggagggttctctttcttaagtgcccttcaaaacccgccccacttttggagttttttggtgatatggcagggctgggcctgatgggagaggcacccagcctgagcgctgtttttgttggctttgagtcgttaggagtttgttccattcaactaatataaaagccaaatttgtgagcctcctctctgacgctgggcctgtggaagccgttggatatttttgaacaggacttggattcgttttgtttccttcccccttttctttccctactcatttgtcctgtcttcttcactcactcttggaaaagtcccaacagagatgaagacgtggaaaaaaaaatcggggtcggggtgtgctggtggggagagggcagagatccggtgaggaatggcttccaccccctggcccattcccctgcaggctggaagatgagaagtgatgtctaaaagtatctttgctggtgtgagaactccagtttccaacacatattatttccctcaactatttggaatattttagaattttaattccaaaggattagtttgaatacaagtatgccacataactcagttttcgccatcttccatttcttaacagtgtaaattaaaagctaataatcataataataaagtgcatttaattatctttga

SEQ ID NO: 362710 - DNA, 1659 bp, Homo sapiens
aagaaaaaaggagaaaaaaaaacaggggtgtgggcgccaggactgaagaatgaggtgtgtgtgtgttggggagtgtagttgtggggagggttctctttcttaagtgcccttcaaaacccgccccacttttggagttttttggtgatatggcagggctgggcctgatgggagaggcacccagcctgagcgctgtttttgttggctttgagtcgttaggagtttgttccattcaactaatataaaagccaaatttgtgagcctcctctctgacgctgggcctgtggaagccgttggatatttttgaacaggacttggattcgttttgtttccttcccccttttctttccctactcatttgtcctgtcttcttcactcactcttggaaaagtcccaacagagatgaagacgtggaaaaaaaaatcggggtcggggtgtgctggtggggagagggcagagatccggtgaggaatggcttccaccccctggcccattcccctgcaggctggaagatctttctcctgtctggcttctcttcttttcaattcgctgcaccaagtgcttccagtggcccaaaaatgctttttgaagtgtgttttgaaacagcccccaccaacatacaccccaccaggagtactgatcctgcctcccttcatgtctaggggaagcattcgcctttgagcacttgtttgcaaatctggggagtttgagacctcctagcatctcttcccttctttccctgcagtctattcactcccgcagccaaaaaatctctggcgttcaggttagcagtttctgggttggtttgtgtgggtttttgttgttgtttggggcttatttttttcaaaaagtgataaagacgggtgggttggagggaggggactgatgggctggtgggctttttagttttcctttgagaaaaagactggtttatttaaaacttgtccagaaaaaaatgaaaaaaaaaaaaaaggtggtatctttgctttagaagaagtctctggataggccctttgtggctgtgggggtgggttgagtgtttacattacattctatatcacaagattgataggatgtttaaagcagatgtttcttatcttcccctgagcccctacaaataaagtcaagacttttctttttttgagacggagtcttgctctgtcgcccaggctggagtgcagtggtgcgatcttggctcactgcaacctccactgcagcgtttctcctgcctcagcctcccaagtagctgggactacaggcgcacgccaccactccttgctaatttttgtatttttagtagacacagggtttcaccatattggccaggctggtctcgaactcctgacctcgttatctgcctgcctcggcctcctaaagtgctgggattacaggagtgagccacagtgcctggcctgtcaagacttctcttaagttaacttcctgagaagtgatgtctaaaagtatctttgctggtgtgagaactccagtttccaacacatattatttccctcaactatttggaatattttagaattttaattccaaaggattagtttgaatacaagtatgccacataactcagttttcgccatcttccatttcttaacagtgtaaattaaaagctaataatcataataataaagtgcatttaattatctttga

SEQ ID NO: 362711 - DNA, 1270 bp, Homo sapiens
aagaaaaaaggagaaaaaaaaacaggggtgtgggcgccaggactgaagaatgaggtgtgtgtgtgttggggagtgtagttgtggggagggttctctttcttaagtgcccttcaaaacccgccccacttttggagttttttggtgatatggcagggctgggcctgatgggagaggcacccagcctgagcgctgtttttgttggctttgagtcgttaggagtttgttccattcaactaatataaaagccaaatttgtgagcctcctctctgacgctgggcctgtggaagccgttggatatttttgaacaggacttggattcgttttgtttccttcccccttttctttccctgcagtctattcactcccgcagccaaaaaatctctggcgttcaggttagcagtttctgggttggtttgtgtgggtttttgttgttgtttggggcttatttttttcaaaaagtgataaagacgggtgggttggagggaggggactgatgggctggtgggctttttagttttcctttgagaaaaagactggtttatttaaaacttgtccagaaaaaaatgaaaaaaaaaaaaaaggtggtatctttgctttagaagaagtctctggataggccctttgtggctgtgggggtgggttgagtgtttacattacattctatatcacaagattgataggatgtttaaagcagatgtttcttatcttcccctgagcccctacaaataaagtcaagacttttctttttttgagacggagtcttgctctgtcgcccaggctggagtgcagtggtgcgatcttggctcactgcaacctccactgcagcgtttctcctgcctcagcctcccaagtagctgggactacaggcgcacgccaccactccttgctaatttttgtatttttagtagacacagggtttcaccatattggccaggctggtctcgaactcctgacctcgttatctgcctgcctcggcctcctaaagtgctgggattacaggagtgagccacagtgcctggcctgtcaagacttctcttaagttaacttcctgagaagtgatgtctaaaagtatctttgctggtgtgagaactccagtttccaacacatattatttccctcaactatttggaatattttagaattttaattccaaaggattagtttgaatacaagtatgccacataactcagttttcgccatcttccatttcttaacagtgtaaattaaaagctaataatcataataataaagtgcatttaattatctttga

SEQ ID NO: 362712 - DNA, 884 bp, Homo sapiens
atggccctgatttccgaatccggctccgtaacccggtagccctccgggttaccccgatggtatcgatccttttttttttgttttaaattatgcagtctgtggcattctgttataacagcatgaaatagacaaaggctccattttcaagagcaagcccttttgtagtttctgagctaattatgactgcaaaggaagttctataggtagcctcagatctaccacctagtaaatctgctactacccagacctagaatctaggattctagatcaagtgctgggcaacatgatacctctgcaacttggcacctccctatatccctccagttggtttggcccatcaggactaatattacccctcatatcctagtctctcttgtaggcagaagccttgcctaaaccctaagctgcttagctcacattctgtcttgttttttttttttttttttttttttttaggagggggttcaaatataaaatatacggaaaagaaatataatgaacctccatgtacccaacacccggattaaacagttatctcaattttgccagacttgtttcatctacttcaatctccctaaacatttacatttgtacaggaaaaactggataaatacctaattctccaccctatctcccattttaagtcatttttcagaataatgagttagtgactagtaacctccactgtagtgaccaatagttttttttcctgaatatcgtaatgagctcatagattattgtttgcatttgagcccattgtagtcactattaattgttttagatgctcatattgtctcaggttaataagtatctcttcaagttgactcccatggccttttgacgtgatcctgttggacttggatggcttccttgctttctggcaa

SEQ ID NO: 362713 - DNA, 451 bp, Homo sapiens
atggccctgatttccgaatccggctccgtaacccggtagccctccgggttaccccgatggtatcgatccttttttttttgttttaaattatgcagtctgtggcattctgttataacagcatgaaatagacaaaggctccattttcaagagcaagcccttttgtagtttctgagctaattatgactgcaaaggaagttctataggtagcctcagatctaccacctagtaaatctgctactacccagacctagaatctaggattctagatcaagtgctgggcaacatgatacctctgcaacttggcacctggctaattttttggaatttttagtagagacggtgtttcaccttgttggccaggctggtcttgaactcctgacctcaggtgatctgcttgccttgacctcccaaagttcagggattacaggcgtgaggcaccatgcccagccag

SEQ ID NO: 362714 - DNA, 560 bp, Homo sapiens
cccagtacatgtgcctgtagatgactgtttattttgtgaatctagggttctgcttcttcaccaggaagaagtgacatctgagtggctgtgctgggttactcatgcagtttgtcttgcctccgaatggtggtagatgttgttactgagtggtcgtgggcatcggggtgagggacctgtgttctgcctcaggaataccagcccaagaggagcttcagtccttcactgcatgaggtgttgtgttttccctgaaagaagaaataagtctgcaaaattccacagtccgtagttctatcctgtggcctctgcgaaaaggaaccttggttctaaatgcctttgtttaacattatttcctagttgccatgtggaacttcctgtgcatttgggtgagaacagctgcaaatcctgaagagccttgtggaggaatcttttcctcttatgtgaagaaaaataaacaatatttttttttggtttggtttggttttgctttgtttttcagacaggatttctgtctcccaggctggaatatagtggtaccatcaccgctcactgcaacctcaacc

SEQ ID NO: 362715 - DNA, 365 bp, Homo sapiens
ggcggccgctgccattgcccggagatggccggcagagccgccgagacgccgaagagcccgccgcccgcgcgaggtgaggcggcccggcccaggacgacggcccgacgggcgggaggggcagccgaactgtggtcgtggtcgctttctggcgctccggggcctgcccctggtcagcctgcagcgtcggcccgtgccccgtgcgccagggcctacagggttggagagcaggccgggcgatggctgctcgggttcccggcgtccgagtctggactggcctcggaacgtgctgtcgtgctggatagcccgtctccaggcccgcttgggcctggtggacgtggtcggttgccctgcctgcttgctgttca

SEQ ID NO: 362716 - DNA, 279 bp, Homo sapiens
ggcggccgctgccattgcccggagatggccggcagagccgccgagacgccgaagagcccgccgcccgcgcgagttgccatgtggaacttcctgtgcatttgggtgagaacagctgcaaatcctgaagagccttgtggaggaatcttttcctcttatgtgaagaaaaataaacaatatttttttttggtttggtttggttttgctttgtttttcagacaggatttctgtctcccaggctggaatatagtggtaccatcaccgctcactgcaacctcaacc

SEQ ID NO: 362717 - DNA, 1783 bp, Homo sapiens
ggcggccgctgccattgcccggagatggccggcagagccgccgagacgccgaagagcccgccgcccgcgcgaggtgtagacggggcactgccttcagagcaggtcctgccagcctcgctggagaggatgccctcgtgtccgtgatgggctgtgggacaagcaaggtccttcccgagccacccaaggatgtccagctggatctggtcaagaaggtggagcccttcagtggcactaagagtgacgtgtacaagcacttcatcacagaggtggacagtgttggccctgtcaaagccgggttcccagcagcaagtcagtatgcacacccctgccccggtcccccgactgctggccacacggagcctccctcagaaccaccacgcagggccagggtagctaagtacagggccaagtttgacccacgtgttacagctaagtatgacatcaaggccctaattggccgaggcagcttcagccgagtggtacgtgtagagcaccgggcaacccggcagccgtatgccatcaagatgattgagaccaagtaccgggaggggcgggaggtgtgtgagtcggagctgcgtgtgctgcgtcgggtgcgtcatgccaacatcatccagctggtggaggtgttcgagacacaggagcgggtgtacatggtgatggagctggccactggtggagagctctttgaccgcatcattgccaagggctccttcaccgagcgtgacgccacgcgggtgctgcagatggtgctggatggcgtccggtatctgcatgcactgggcatcacacaccgagacctcaaacctgagaatctgctctactaccatccgggcactgactccaagatcatcatcaccgacttcggcctggccagtgctcgcaagaagggtgatgactgcttgatgaagaccacctgtggcacgcctgagtacattgccccagaagtcctggtccgcaagccatacaccaactcagtggacatgtgggcgctgggcgtcattgcctacatcctactcagtggcaccatgccgtttgaggatgacaaccgtacccggctgtaccggcagatcctcaggggcaagtacagttactctggggagccctggcctagtgtgtccaacctggccaaggacttcattgaccgcctgctgacagtggaccctggagcccgtatgactgcactgcaggccctgaggcacccgtgggtggtgagcatggctgcctcttcatccatgaagaacctgcaccgctccatatcccagaacctccttaaacgtgcctcctcgcgctgccagagcaccaaatctgcccagtccacgcgttccagccgctccacacgctccaataagtcacgccgtgtgcgggaacgggagctgcgggagctcaacctgcgctaccagcagcaatacaatggctgagccgcctggctgtgcacacatgcagcacgacccagcctggccacacactgtggtgccatctgggtccgatgccctctctggagataggcctatgtggcccacagtaggtgaagaatgtctggctccagccctttctctgtgccttcagcagcccctgtcctcaccatgggcctggtcctgagggcaggacagggggtttggagatgtgggcctttgatagacccacttgggccttcatgccatggcctgtggatggagaatgtgcagttatttattatgcgtattcagtttgtaaacgtatcctctgtattcagtaaacaggctgcctctccagggagggctgccattcattccaacaaaaaaag

SEQ ID NO: 362718 - DNA, 3461 bp, Homo sapiens
ggcggccgctgccattgcccggagatggccggcagagccgccgagacgccgaagagcccgccgcccgcgcgaggtgtagacggggcactgccttcagagcaggtcctgccagcctcgctggagaggatgccctcgtgtccgtgatgggctgtgggacaagcaaggtccttcccgagccacccaaggatgtccagctggatctggtcaagaaggtggagcccttcagtggcactaagagtgacgtgtacaagcacttcatcacagaggtggacagtgttggccctgtcaaagccgggttcccagcagcaagtcagtatgcacacccctgccccggtcccccgactgctggccacacggagcctccctcagaaccaccacgcagggccagggtagctaagtacagggccaagtttgacccacgtgttacagctaagtatgacatcaaggccctaattggccgaggcagcttcagccgagtggtacgtgtagagcaccgggcaacccggcagccgtatgccatcaagatgattgagaccaagtaccgggaggggcgggaggtgtgtgagtcggagctgcgtgtgctgcgtcgggtgcgtcatgccaacatcatccagctggtggaggtgttcgagacacaggagcgggtgtacatggtgatggagctggccactggtggagagctctttgaccgcatcattgccaagggctccttcaccgagcgtgacgccacgcgggtgctgcagatggtgctggatggcgtccggtatctgcatgcactgggcatcacacaccgagacctcaaacctgagaatctgctctactaccatccgggcactgactccaagatcatcatcaccgacttcggcctggccagtgctcgcaagaagggtgatgactgcttgatgaagaccacctgtggcacgcctgagtacattgccccagaagtcctggtccgcaagccatacaccaactcagtggacatgtgggcgctgggcgtcattgcctacatcctactcagtggcaccatgccgtttgaggatgacaaccgtacccggctgtaccggcagatcctcaggggcaagtacagttactctggggagccctggcctagtgtgtccaacctggccaaggacttcattgaccgcctgctgacagtggaccctggagcccgtatgactgcactgcaggccctgaggcacccgtgggtggtgagcatggctgcctcttcatccatgaagaacctgcaccgctccatatcccagaacctccttaaacgtgcctcctcgcgctgccagagcaccaaatctgcccagtccacgcgttccagccgctccacacgctccaataagtcacgccgtgtgcgggaacgggagctgcgggagctcaacctgcgctaccagcagcaatacaatggctgagccgcctggctgtgcacacatgcagcacgacccagcctggccacacactgtggtgccatctgggtccgatgccctctctggagataggcctatgtggcccacagtaggtgaagaatgtctggctccagccctttctctgtgccttcagcagcccctgtcctcaccatgggcctgggccaggtgtgacagagtagaggtagcacagggggctgtgactccccctgaactgggagcctggcctggcactgatacccctcttggtgggcagctgctctggtggagttgggaagggataggacctggccttcactgtctcccttgccctttgacttttccccaatcaaagggaactgcagtgctgggtggagtgtcctgtggcctcaggaccctttgggacagttacttctgggaccccctttcctccacagagcccttctccctggtttcacacattcccatgcatcctgatccttaagattatgctccagtgggagaccctggtaggcacaaagcttgtgccttgactggacccgtagcccctggctaggtcgaaacagccctccacctcccagccaagatctgtcttccttcatggtgcctccagggagccttcctggtcccaggacctctggtggagggccatggcgtggaccttcacccttctggactgtgtggccatgctggtcatcggcttgcccaggctccagcctctccagattctgaggggtctcagcccaccgcccttggtgccttctttgtagagcccaccgctacctccctctccccgttggatgtccattccattccccaggtgcctccttcccaactgggggtggttaaagggagccccactgctgctacctggggaatggggcacctgggggccaaggcagagggaagggggtcctcccgattagggtcgagtgtcagcctgggttctatcctttggtgcagccccattgccttttcccttcaggctctgttgctccctcctctgcagctgcacgaaggcgccatctggtgtctgcatgggtgttggcagcctgggagtgatcactgcacgcccatcgtgcacacctgcccatcgtgcacacccacccatggtgcacacctgtagtcctccatgaggacatgggaaggtaggagttgccgccctgggggagggtcccgggctgctcacctctccccttctgctgagcttctgcgcacccctccctggaacttagccatactgtgtgacctgcctctgaaaccagggtgccaggggcactgccttctcacagctggccttgccccgtccaccctgtgctgcttcccttcacagcattaaccttccagtctgggtcccactgagcctcaagctggaaggagcccctgcgggaggtgggtggggttgggtggctgctttcccagaggcctgagccagaaccatccccatttcttttgtggtatctccccctaccacaaaccaggctggaacccaagccccttcctccacagctgccttcagtgggtagaatggggccagggcccagctttggccttagcttgacggcagggcccctgccattgcaggagggtttggttcccactcagcttctgccggtcggcagcctgggccaggcccttttcctgcatgtgccacctccagtgggaaacaaaactaaagagaccactctgtgccaagtcgactatgccttagacacatcctcctaccgtccccaatgccccctgggcaggaggcagtggagaaccaagccccatggcctcagaatttccccccagttccccaagtgtctctggggacctgaagccctggggcttacgttctctcttgcccagggtgggcctggtcctgagggcaggacagggggtttggagatgtgggcctttgatagacccacttgggccttcatgccatggcctgtggatggagaatgtgcagttatttattatgcgtattcagtttgtaaacgtatcctctgtattcagtaaacaggctgcctctccagggagggctgccattcattccaacaaaaaaag

SEQ ID NO: 362719 - DNA, 3539 bp, Homo sapiens
ccgcgtttgcgtagggtgcgtcatgccaacatacatccagctggtggaggtgttcgagacacaggagcgggtgtacatggtgatggagctggccactggtggagagcgctttgaccgcatcattgccaagggctccttcaccgagcgcgaggtgtagacggggcactgccttcagagcaggtcctgccagcctcgctggagaggatgccctcgtgtccgtgatgggctgtgggacaagcaaggtccttcccgagccacccaaggatgtccagctggatctggtcaagaaggtggagcccttcagtggcactaagagtgacgtgtacaagcacttcatcacagaggtggacagtgttggccctgtcaaagccgggttcccagcagcaagtcagtatgcacacccctgccccggtcccccgactgctggccacacggagcctccctcagaaccaccacgcagggccagggtagctaagtacagggccaagtttgacccacgtgttacagctaagtatgacatcaaggccctaattggccgaggcagcttcagccgagtggtacgtgtagagcaccgggcaacccggcagccgtatgccatcaagatgattgagaccaagtaccgggaggggcgggaggtgtgtgagtcggagctgcgtgtgctgcgtcgggtgcgtcatgccaacatcatccagctggtggaggtgttcgagacacaggagcgggtgtacatggtgatggagctggccactggtggagagctctttgaccgcatcattgccaagggctccttcaccgagcgtgacgccacgcgggtgctgcagatggtgctggatggcgtccggtatctgcatgcactgggcatcacacaccgagacctcaaacctgagaatctgctctactaccatccgggcactgactccaagatcatcatcaccgacttcggcctggccagtgctcgcaagaagggtgatgactgcttgatgaagaccacctgtggcacgcctgagtacattgccccagaagtcctggtccgcaagccatacaccaactcagtggacatgtgggcgctgggcgtcattgcctacatcctactcagtggcaccatgccgtttgaggatgacaaccgtacccggctgtaccggcagatcctcaggggcaagtacagttactctggggagccctggcctagtgtgtccaacctggccaaggacttcattgaccgcctgctgacagtggaccctggagcccgtatgactgcactgcaggccctgaggcacccgtgggtggtgagcatggctgcctcttcatccatgaagaacctgcaccgctccatatcccagaacctccttaaacgtgcctcctcgcgctgccagagcaccaaatctgcccagtccacgcgttccagccgctccacacgctccaataagtcacgccgtgtgcgggaacgggagctgcgggagctcaacctgcgctaccagcagcaatacaatggctgagccgcctggctgtgcacacatgcagcacgacccagcctggccacacactgtggtgccatctgggtccgatgccctctctggagataggcctatgtggcccacagtaggtgaagaatgtctggctccagccctttctctgtgccttcagcagcccctgtcctcaccatgggcctgggccaggtgtgacagagtagaggtagcacagggggctgtgactccccctgaactgggagcctggcctggcactgatacccctcttggtgggcagctgctctggtggagttgggaagggataggacctggccttcactgtctcccttgccctttgacttttccccaatcaaagggaactgcagtgctgggtggagtgtcctgtggcctcaggaccctttgggacagttacttctgggaccccctttcctccacagagcccttctccctggtttcacacattcccatgcatcctgatccttaagattatgctccagtgggagaccctggtaggcacaaagcttgtgccttgactggacccgtagcccctggctaggtcgaaacagccctccacctcccagccaagatctgtcttccttcatggtgcctccagggagccttcctggtcccaggacctctggtggagggccatggcgtggaccttcacccttctggactgtgtggccatgctggtcatcggcttgcccaggctccagcctctccagattctgaggggtctcagcccaccgcccttggtgccttctttgtagagcccaccgctacctccctctccccgttggatgtccattccattccccaggtgcctccttcccaactgggggtggttaaagggagccccactgctgctacctggggaatggggcacctgggggccaaggcagagggaagggggtcctcccgattagggtcgagtgtcagcctgggttctatcctttggtgcagccccattgccttttcccttcaggctctgttgctccctcctctgcagctgcacgaaggcgccatctggtgtctgcatgggtgttggcagcctgggagtgatcactgcacgcccatcgtgcacacctgcccatcgtgcacacccacccatggtgcacacctgtagtcctccatgaggacatgggaaggtaggagttgccgccctgggggagggtcccgggctgctcacctctccccttctgctgagcttctgcgcacccctccctggaacttagccatactgtgtgacctgcctctgaaaccagggtgccaggggcactgccttctcacagctggccttgccccgtccaccctgtgctgcttcccttcacagcattaaccttccagtctgggtcccactgagcctcaagctggaaggagcccctgcgggaggtgggtggggttgggtggctgctttcccagaggcctgagccagaaccatccccatttcttttgtggtatctccccctaccacaaaccaggctggaacccaagccccttcctccacagctgccttcagtgggtagaatggggccagggcccagctttggccttagcttgacggcagggcccctgccattgcaggagggtttggttcccactcagcttctgccggtcggcagcctgggccaggcccttttcctgcatgtgccacctccagtgggaaacaaaactaaagagaccactctgtgccaagtcgactatgccttagacacatcctcctaccgtccccaatgccccctgggcaggaggcagtggagaaccaagccccatggcctcagaatttccccccagttccccaagtgtctctggggacctgaagccctggggcttacgttctctcttgcccagggtgggcctggtcctgagggcaggacagggggtttggagatgtgggcctttgatagacccacttgggccttcatgccatggcctgtggatggagaatgtgcagttatttattatgcgtattcagtttgtaaacgtatcctctgtattcagtaaacaggctgcctctccagggagggctgccattcattccaacaaaaaaag

SEQ ID NO: 362720 - DNA, 490 bp, Homo sapiens
aagtatatgagaacaaagggacatcgtcaagatggcaactagacttgcctggtgcttggtttgtgccccacgactgccatcaaaaaggaccaaaacaacaaataaacaactatatctcaattggagagtctgagactgtataccggggagcaccaggggagcagtcagatccctgtggagcatggaagtgtagcgtaacaccacagagaggggagcaaggcatcctacctctccaatactgtctaccctgccatgcttgtcctggagccaaggggacttcttatggggagatggtaagcaggagatccttggcagttccccatcaccaccacaaacactggcagcaattcctacaagagggtcctccagtcttcaaaggccacaaatcttgtgtagacagttgtcacacatgtacacagctgcattgccccagagaaggaacctctgggatagcccccacccctgtggcctaagctgccatggcacagtg

SEQ ID NO: 362721 - DNA, 456 bp, Homo sapiens
gtgtttataagatataaaagaagatatttagtgtgtgtttatttgaaacattttacatttttactctacttctttaacctctgttatggttatagctagctcgtgtactgcgtataaatgtatgcatctgtattcgccatctacaccaaaataaacctttgaaattattgccaggcagaattaatgagctcagttctaacagcgcaaagaatatcttcatactacaggtaaaacaaacagcttctcccttcccttcttctgcacagaatggctctacgaagtctgcctgcaaaattacgtcttttagaaaaccaagtagctggctgttttgtgagcagggaggatttcaggacgaaccacaaacaagctgtttgtttagattttaaggttgacagttcatttacacgtatgccccataagtattctataacatagtcctgaaaaagcactgaagaa

SEQ ID NO: 362722 - DNA, 607 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttaccc

SEQ ID NO: 362723 - DNA, 636 bp, Homo sapiens
gcgaattgggaaaccgggcaccccctcggtgccgcaaaaatcggaggaaaaaagcccaacctcaggtacatcatcggaaaggacacttggttggagcaatggcccgaggaggacgaatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362724 - DNA, 381 bp, Homo sapiens
  misc_feature (12)..(12): n is a, c, g, or t
cccatgcctccnaaggaatcaaagtttaaactagcctgcaccctcctcccactgcaatgtctagttaactttgtaatcccacaggttttctttttgctccattgagaaagccacttttaatattttaaagttgctctctgtaccacccccaccttccccccataagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362725 - DNA, 277 bp, Homo sapiens
ccgtcgaattcgtggtcgctcgctggagctcgcaaggtcacttttcaataggatggactttgaagacttggggttggtagtagattgggaccaccacctgcctccaccagctgccaagactgtggttgagaacctccccaggacagtcatcagaggctctcaggctgaggaggagactgccattgagatgccttgccatcaccttttccattccagtttctcaagttagttataggatgtacataagcagtaagcgtaattaggtaaacagcaccac

SEQ ID NO: 362726 - DNA, 111 bp, Homo sapiens
tcaagcttctaacgatgtacggggatgtacacgtgaggaggttggggctgagtgctggccctctgcgtcttccttattaaccttgaatcctcattaaaggtttctttaccc

SEQ ID NO: 362727 - DNA, 928 bp, Homo sapiens
  misc_feature (788)..(788): n is a, c, g, or t
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaaaaaaaaaaaaaaaaaaaaaacccggggccttttttgggggggggaaaaaagggttgaacttcgacctggcaatggctgttcctgacccccgcttcttgtcagggggaaatctgcgcggctcccatatagggagccgagttaattcaaaagcacggttccgacatcttccccgacagacngtcgccacgcagaggtccggggggggcacaccataacacaagcgcgtagaactacaaaaacggacatctagcgtacggacacagcgcatatacagcaggcacaccacatcttcagcacaccaagcccaactgttatggat

SEQ ID NO: 362728 - DNA, 815 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccgatacaaaaatgaaattgaaagccttaattcttgtcggacgcctcggcccatttgactctagactcgaggaaacttatgcattcgggccaaatccgagcttacttggccaattcacctatagtgagtgttattccatttactggcccccgtttacaaagtgtcactggccccggggttccaaacttggcttgaaccatcccctgttgg

SEQ ID NO: 362729 - DNA, 764 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttaccctagaaaaaaacaaaatatatttgccgcatcgagccctgtgcattgcctaagtattcgttacatcatggcggtttaaacgtgttacgggaaactgtggttcaatattggtttgaaatccctttcgcgggttatgaagcgcgaacttccagatggctat

SEQ ID NO: 362730 - DNA, 1574 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataagtgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362731 - DNA, 1717 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgttttccaggtcaggtgggggcaagtgtccttcaggagtgggagcttgggaggcagagctgtagcagctctcctgatcagcactccttcctaaagagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362732 - DNA, 1587 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362733 - DNA, 1513 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362734 - DNA, 532 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaaggctcgaaaacagcagcagcaacaccgactggagaacctccatggagccatgtacacgtgaggaggttggggctgagtgctggccctctgcgtcttccttattaaccttgaatcctcattaaaggtttctttaccc

SEQ ID NO: 362735 - DNA, 818 bp, Homo sapiens
  misc_feature (678)..(678): n is a, c, g, or t
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaaaaaaaaaaaaaaaaaaaaaacccggggccttttttgggggggggaaaaaagggttgaacttcgacctggcaatggctgttcctgacccccgcttcttgtcagggggaaatctgcgcggctcccatatagggagccgagttaattcaaaagcacggttccgacatcttccccgacagacngtcgccacgcagaggtccggggggggcacaccataacacaagcgcgtagaactacaaaaacggacatctagcgtacggacacagcgcatatacagcaggcacaccacatcttcagcacaccaagcccaactgttatggat

SEQ ID NO: 362736 - DNA, 648 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttaccc

SEQ ID NO: 362737 - DNA, 712 bp, Homo sapiens
  misc_feature (572)..(572): n is a, c, g, or t
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaaaaaaaaaaaaaaaaaaaaaacccggggccttttttgggggggggaaaaaagggttgaacttcgacctggcaatggctgttcctgacccccgcttcttgtcagggggaaatctgcgcggctcccatatagggagccgagttaattcaaaagcacggttccgacatcttccccgacagacngtcgccacgcagaggtccggggggggcacaccataacacaagcgcgtagaactacaaaaacggacatctagcgtacggacacagcgcatatacagcaggcacaccacatcttcagcacaccaagcccaactgttatggat

SEQ ID NO: 362738 - DNA, 621 bp, Homo sapiens
aagtcacagtgtacaacacgttttaagacggcatactatacgtcctaggtgcgaggctgggtggcgatctcaagctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttaccc

SEQ ID NO: 362739 - DNA, 480 bp, Homo sapiens
cggtggcggcgcatacttcgtatatcatcattatacgaagttatctagatctcggcgcgccaccctagagtttctgtggaccccatgtgcccctctcctctcaaacctctgaaccaagcagtgtggcctggttctctacaggctaacaagtctccaacttctattgagctgcttggcctgtttctttgtcccctgataacaacccagctcttcagtgactacttggcttggtctctcatactcctctcttctccagatctcctgtggttatattgccttttgtcctacaactccactagctccacttcccctgtaattgctcagcttggtccccagagctgtaggtcttctctgtgttctaccactcccacctgtcccagagactgctctgtcatgtacacgtgaggaggttggggctgagtgctggccctctgcgtcttccttattaaccttgaatcctcattaaaggtttctttaccc

SEQ ID NO: 362740 - DNA, 1623 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362741 - DNA, 778 bp, Homo sapiens
  misc_feature (610)..(610): n is a, c, g, or t
  misc_feature (612)..(612): n is a, c, g, or t
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccgcngntaataggcaaataataaagtcggagtgaagatgaaaatgaaaaaaacattctgaaaaagataccctggtgggccgccttggcccaatctattctagactggagcaagtttatgcttgcggccgaatttcgagctcactggcccattacgccttatgggaggggtat

SEQ ID NO: 362742 - DNA, 734 bp, Homo sapiens
  misc_feature (638)..(638): n is a, c, g, or t
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaaaaaaaagaataagctatgcattgcggcgnatgcgagctccttgggcaattcgcccatatgagtcgtttacagtcctgggccggcgtttcaaagtccgactgtgaaaccctggggttcccacgtag

SEQ ID NO: 362743 - DNA, 1795 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaaggtactgcttctcttcttctagctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362744 - DNA, 1685 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagagcttgccccaatttttttttttccccttttttgggggggccccccccccccccccttttttgggggggggggccctcccgagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362745 - DNA, 1371 bp, Homo sapiens
gcacgagtcactcagagcgctctcagtgcgtgcagtctccagtgcccttttttaatttgttttccgaaaagaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttacccaccctgaggctgtattgatcacagacctggccaggggctctgcatcctccatcaggtctctacttctgttggggaaggtgatcctaaatcgcagaaggcaccaggctgcggttttcctccctgctggcccatctggactcatggcagtggtaaagaactggattactgcaatagccagggcttgggcctatgtgttcatggttggaaggcaaaatgtgtcagggtctggtacccagttaattacttaaagctgataaactaggctgggtgcagtggctcatgtctgtaatgccagcagtttgggaggccaagacaggtggatcacgaggtcaggagttcgagaccttcctgaccaacatggtgaaaccccgtttctactaaaaatacaaacattagctgggcatggtggcacgcacctgtaatcccagctacttgggaggctgaggcaggagaattgcttgaacctgggaggcagaagttgcagtgagctgagatcatgccattgcactctagcctgggcaacaagagcaaaactccgtctcaaaaaaaaaaaaaaaaaaagctgataaactagcctgcaccctcctcccactgcaatgtctagttaactttgtaatcccacaggttttctttttgctccattgagaaagccacttttaatattttaaagttgctctctgtaccacccccaccttccccccatgcctcctaaggaatcaaagttcaaaccagactctgagtgggggatgggtgagattatcagaccaagttagttctttagattgcttagaggcccagaagggtttcaagccctttgaaggggtatttgggtggcacctggcatcctttgtttctggcaacagagtgcactcagcactcctggggggcaagggcttcctcccatccttggcttatggaaagccatcccagatcaggccccccaactctccagaacaggctacaaacatgcaaattagaattcttttaatataaaaaaaagtactaaaataaaaacg

SEQ ID NO: 362746 - DNA, 779 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaaggtactgcttctcttcttctagctctcaccgtgccctgggcccagtactcaagcttctttctgttcatggactgctgggggatggaagaagagtggcagttgggagcaggggagggtggttatcagcttatgaagatcagaccaaggctagaacactactctacttttctcagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttaccc

SEQ ID NO: 362747 - DNA, 571 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttaccc

SEQ ID NO: 362748 - DNA, 497 bp, Homo sapiens
gtatcaacgcagagtgcccattacggccggggagcagggtccgagggctgtgtcagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgacaaattcctgtcccttgtgccgctatgagctgcccactgatgacgacacttatgaggagcacagacgagataaggctcgaaaacagcagcagcaacaccgactggagaacctccatggagccatgtacacgtgaggaggttggggctgagtgctggccctctgcgtcttccttattaaccttgaatcctcattaaaggtttctttaccc

SEQ ID NO: 362749 - DNA, 6730 bp, Homo sapiens
ctgtcggcgggaagcggcgatcctgccaccgggaggtgtggaagagccggattctggctacattggagattggttgctttctaaaactgaaggagaagcccatgaagagatggtggattctcactgagttttgactagcggaagaaaagagagagttcaagtggatggccttgaggacttgaaaagctgagatatgatgattttgaagtcatttcacatcgaagccatgatttaaatatcggcgttaagatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362750 - DNA, 8314 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362751 - DNA, 692 bp, Homo sapiens
ggtgagtgttctatttgtgtcttttgcacattttattgatatttattttttccttatgtatgtcccttcatgtattaaggatattaactagttgctgtattacaaatatttcccatttgttacttggtttttcttttctttttaattttgcattgtttttcatttttatataattaatgcattattttcccttttgattggttcttttactattgcacttgaaaaggctttctccaccttgaagctcagataaatcctacctgtgtttccacagtgctttgaattatttcatattttacattcattcttcatctggaatttactttgatgcacatgatatcttcagctttgttctcttttctttcaaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccaggtaaggcctgcagggggcagctatgctgagcagtagaaggcacatcttccagaaagccttttgattttacgttggtatttattaagcagcttctgtttgccaagtacattcccagagcacccagaacatgtgcttacactcttttcatcctcacccctacaccaaaa

SEQ ID NO: 362752 - DNA, 639 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaagtaagtgaaaaatcttcctataaatctaaatgcagtaggtttttttttgttgtttttgtttttgcttttttttaagtgccatct

SEQ ID NO: 362753 - DNA, 1169 bp, Homo sapiens
tatatacccacaaattttaaatttaaaaaaagcagacaataacaagtattggcaaggatgtgaaaattggaacccttacacattacttggaaaacagtctagcaatttctcaaaagatttaacaatacagttaccatatgactagcaactctactagatatctacccaagagaaatgaaaacacttgtacatgaaggttcatagccatattagtcatagtggccaaaagatggaaataacccaaatatctaccaacatattaatggatgaaaaaaattagtggaatattattctgccataaaaaagaattcagtattgatacatgctacaacatggatgcaccttaaaaacattacactaagtttaaaaactcagtcacaaaggaacatatatatataattccatctgtatgaaatgtccaaaacaggcaagtccataaatacaggagtagattagtggattctgaggactaaggatgggggaaatgcggagtgactgctaacgggtacagggcttcttcttccgggagatgaaaatgttctgaaattagtgatgacagttgcacaactctgtgaataaactgaaatctgtacacataaaaagagtgaattttatgacatgtgaattatatctcaataaagctattataaagctgttatcataatagtaataataattttgggtcaccagcactctccagacttataaagaactcttggagtttctcccttgcagatgtcccctggaagcaggactgcatagtagcagcaaagtcacaatacacgagtgtgatgaaggctccgagccactcggattctgggatgccttaggaaggagagacaggaaagcctacgattgcatgcttcaaggtaatgtggcatccacagtctgcgatctggtttttttgtttgtttttggaaacaagagtcttgctctgttatccaggctggagtatagtggtatgatcacagctcactgcagcttcaacctcctgggctcaagtgatcagcctgcctcagcctctcaaagtgcaggcttgagccactgtgccccattcatgttttatcttaattcttcagtgtgtcttaaatctagtgtgatgagtattatgtccagctgattgaacagtttttttcttcccaggggtgagtttaacttggacaccagga

SEQ ID NO: 362754 - DNA, 532 bp, Homo sapiens
cttatactcaactccattgtcaatattattttccccaagaagaaaaataaaaaatgaaaagacacaacactaatcttttgtctccacaggatgtggcaaaatgagaaataacaattacacgttattttcaaaggtggtccgactgcttcagccgtggaccacttacactaaagagaaaatttccagcacttcacaagatccagctgttctttcacagacgactaataaaaaagtaaaagaagcgacattaagctgcgcccaaacaggccaggaatgggtcctaaggcatcacgaaacttcccgaggacattatgtatttagagaaggccccacagaaaccctcaagcgggaaagttacgtcttctgggtctcggggtggcaggcagcctgaaccccgaggggctcgaggcgaggcgcccccggccggattcgggcccaaaccagcccgccacgccctgagctccgcgcagcaaaccggccggccgagcggcggccctcggaatggtgttttctcggcgccacaggagggaga

SEQ ID NO: 362755 - DNA, 475 bp, Homo sapiens
gcaccaccaaggccccgcgctagtgtgcacccccggcccgggcccggcaggtgggcgaggagggcgggcgcagtcgggctctgcaggagcgcgcggagattctggctacattggagattggttgctttctaaaactgaaggagaagcccatgaagagatggtggattctcactgagttttgactagcggaagaaaaggtctttagacaataacttaactctttcaaccaatttccagacagaaaatctttgactccacctatgacctgtaagcccccaccccccaagttgtcccgcctttctggatcgaaccagtgtataccttccatgtattgattaatgtcttctgtctctgtaaagcacataaaaccaagctgtaacccaaccgccttgggtacatgttctcaggagctcttgagtctgtgtcacaggtcatgatccataaccttggcaaaataaacttctaaattgactga

SEQ ID NO: 362756 - DNA, 6574 bp, Homo sapiens
gcacttgggctgtggtttcctggagatgggagatcgggagctttggtgtacttcttgaaggtttcagaaaaaggccaagacttcttcagaactatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362757 - DNA, 8056 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcaggtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362758 - DNA, 8238 bp, Homo sapiens
  misc_feature (7819)..(7819): n is a, c, g, or t
  misc_feature (7821)..(7821): n is a, c, g, or t
  misc_feature (7823)..(7823): n is a, c, g, or t
  misc_feature (7826)..(7826): n is a, c, g, or t
  misc_feature (7831)..(7831): n is a, c, g, or t
  misc_feature (7835)..(7836): n is a, c, g, or t
  misc_feature (7839)..(7839): n is a, c, g, or t
  misc_feature (7846)..(7847): n is a, c, g, or t
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaattttgttttcncncnaangcaanttgnnttncactccnnttccaagcatgtgttgggggtccaaactaccctgaaccggttacatgggcagtgcactctggggaattaagtctggcccccaatatgtttcttcataccggttgggaaggttccggcacatacgggagaactggccgagaaaggcccggggcaacggtcaccaattggctaagggccgggcggggaacactgcgacagcgctaaatccccttaaaaccgtcgggtggtgacaacagaaaccacctgggggagccgagacggcgcgaccaacaacacacccactaggggcgtcaacacacctcgcaccccagggagctcgcgtgttggtgtcacaaacatacgcacagcacatagggaggaaacacacacgcaacagaccgagcctatgtgg

SEQ ID NO: 362759 - DNA, 5659 bp, Homo sapiens
aggtcaagagatcaagaccatcctggccaacatggtgaaacctcatctctaataaaaatacaaaaattaactgggcgtggtggtgcgcgcctgtaatcccagctactcaggaggctgaggcaggagaatcacttgaccccgggaggcggagtttgcagtgagccaagatcatgccactgcactccagcctggtgacagagacagactccatctccaaaaaagaaaaagaaagaaaaaaattagattggaaacaatattctaaaacacagacataatctactgattttttgatagctaatatttgcttttttgaattattattttttttacaccaagacatgtattctcaagacagagtaaatcctcccagctctgaacacctattcttaccccattggctttgggtagccactatctcttatttcctgagttggtatttgcttttgaagttctttcgtgattttttctccccaaaaataattagcaaaatattctgttaaaatttttgatttaacgtttctgaatttaaaactatgctgtccttaatgcttcttttcttctctctccttatgaatgtttcctcttgtggcaattgcttttaaagtgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcaggtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362760 - DNA, 8359 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacacactctccagacttataaagaactcttggagtttctcccttgcagatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362761 - DNA, 3989 bp, Homo sapiens
agccttcagagtcagtcctgttcattagctgcggagttaacggcctctgtgctaatgaactcctctgatgtctcttctcttaagcatccttctagtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362762 - DNA, 3014 bp, Homo sapiens
ttttacaatgtgaaattcattcacattttacattgcagctactttgcaatgtaaaatgtgatgctctcctgttcttcttatccccaagctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362763 - DNA, 2393 bp, Homo sapiens
tctcaccatgttcccaaggctggtcttgaactcctgagctcaagcgatcctcccacctcagcatcccaaagatttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362764 - DNA, 2451 bp, Homo sapiens
tatatacccacaaattttaaatttaaaaaaagcagacaataacaagtattggcaaggatgtgaaaattggaacccttacacattacttggaaaacagtctagcaatttctcaaaagatttaacaatacagttaccatatgactagcaactctactagatatctacccaagagaaatgaaaacacttgtacatgaaggttcatagccatattagtcatagtggccaaaagatggaaataacccaaatatctaccaacatattaatggatgaaaaaaattagtggaatattattctgccataaaaaagaattcagtattgatacatgctacaacatggatgcaccttaaaaacattacactaagtttaaaaactcagtcacaaaggaacatatatatataattccatctgtatgaaatgtccaaaacaggcaagtccataaatacaggagtagattagtggattctgaggactaaggatgggggaaatgcggagtgactgctaacgggtacagggcttcttcttccgggagatgaaaatgttctgaaattagtgatgacagttgcacaactctgtgaataaactgaaatctgtacacataaaaagagtgaattttatgacatgtgaattatatctcaataaagctattataaagctgttatcataatagtaataataattttgggtcaccagcactctccagacttataaagaactcttggagtttctcccttgcagatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362765 - DNA, 1362 bp, Homo sapiens
gaagaaaagatttcaagggaaatcagagaaagacagggtctccctggggtctactgacattgccatctgtgtaactacaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362766 - DNA, 6537 bp, Homo sapiens
  misc_feature (6491)..(6491): n is a, c, g, or t
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatgttgaagaaaggtttggcgtcacctactgtacttnccatgagagatgccccggccgaattgagatcctctagatcgaccca

SEQ ID NO: 362767 - DNA, 6509 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagggttagtgagcgcttgtggttttttccagctgaaagaggctggcccggcagccctgcgggagccagcttctccaatgaaccctgtcatgccctctgctgcgtccgtgcagtggggcactgcagtcatgcgcctttgagagccacctagtaaactacagagatgaaaagaagtaaggccgaattcctaacaacctagcattgccgaggccgctggtgttcacctgtagaaattgaacttgcacatcaaggcttctcagctccctctctccctcccctgcccctgtccccagagcttttctgggaaagagatgattggcctctaaatgatatttcccatgtggctgtgtgctgcttcaattaaagtcgttaagtacaaa

SEQ ID NO: 362768 - DNA, 5270 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaagcctcagactgcacttatccgacgaccaccg

SEQ ID NO: 362769 - DNA, 1150 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacagggaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362770 - DNA, 317 bp, Homo sapiens
gcaccaccaaggccccgcgctagtgtgcacccccggcccgggcccggcaggtgggcgaggagggcgggcgcagtcgggctctgcaggagcgcgcggagattctggctacattggagattggttgctttctaaaactgaaggagaagcccatgaagagatggtggattctcactgagttttgactagcggaagaaaagaggaaatagatgaaaagtgaagtcggtgcctgcagtctctggggtctctgcgcctggtgttccaaggaggattttgatctggtccctcatcagactctgttgttgctcttagggttggat

SEQ ID NO: 362771 - DNA, 371 bp, Homo sapiens
aggccttagtgatgctgtctcactgacggtttctgcttgcctagatatcgaagccagaccagatatgcagttagaatcggacctgaagttggacaggctggaaacctttctaagaaggctgaataacaaaggtacctactggaagccagaaggctttgctttcagaatctctaaatcctaattctgattgcttttcttcctcagccaaaaaaaagaagttttggtcaagactgattagagaaacaagccctgattcacttgataacgtactaaattggggattcccaataatacatttttttcttgaatctaagcccttgggatgccatccaattggaattgtgaactgagtgattttgcttataactctg

SEQ ID NO: 362772 - DNA, 401 bp, Homo sapiens
ggccccggccacgccaagcagtttctgatcagaagaggccttagtgatgctgtctcactgacggtttctgcttgcctagatatcgaagccagaccagatatgcagttagaatcggacctgaagttggacaggctggaaacctttctaagaaggctgaataacaaaggtacctactggaagccagaaggctttgctttcagaatctctaaatcctaattctgattgcttttcttcctcagccaaaaaaaagaagttttggtcaagactgattagagaaacaagccctgattcacttgataacgtactaaattggggattcccaataatacatttttttcttgaatctaagcccttgggatgccatccaattggaattgtgaactgagtgattttgcttataa

SEQ ID NO: 362773 - DNA, 319 bp, Homo sapiens
ggttaaatgcaaaccgattcattccatttcatttaagtatatatttctaggctttggaaattacatcctatgatttttttaaaacttttctcccccagattctggctacattggagattggttgctttctaaaactgaaggagaagcccatgaagagatggtggattctcactgagttttgactagcggaagaaaaggtaattattgatgatttcggaatatgtttgcagtatcatgtggagttcagctgcagtagcagcaaagacaaaactgagagttttagacattttctgttataataacaactggtaccactcta

SEQ ID NO: 362774 - DNA, 521 bp, Homo sapiens
aaacagactcagcaggaggcaggagggcggcaaggcgccggccagcagcctgcacacccaggaagcagggcggtccctcatcaagaaggtaacattccccatgttaggaaaagccttccgactaacatcactcttggaagtgcatcaaaaagacaagcgtgtgccacctaattcctactctgtgaagcatttgtgcatttttgcccttagggtacacactgagagtctgtcacagagcagctaaaattgggcagaaggctgtgcctggagatgttttaaaactgggatcagcaacacacacacactatgtcagcaagcaagtgcctgaattttaaagtgtggactttttcttcagtttaaaaaccttcttaaatgaagtctggctttcatgtgttattaaagcctttataatgaaaaaaattgaattcaccactaatatctttaagttccatgtaaaatacagacttgtgtttcccatgcagagattttaaacctaagtataaaaaataaggacataattg

SEQ ID NO: 362775 - DNA, 531 bp, Homo sapiens
ctccaggtgccaacggtttctcccctgccctaggtccgaggctctttgccactggtccttgcaggcccggggaaagtgagccagacatttgcttctcctcgggtgtctcagctgctgacctgtccctctgccattctgtgtttgcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtgagtcctggggagctctgcaccccggggactgagaggagcatcctctcctgggagccgatggcactcggcctggtccctcccaacatgattctgataatggaagaccacgtcacccaaagcacttcagtcctggtctggcttctgcaggtctcaggctgtgcctcccatttctttcctcctcccactttttgtaagatgatcctggagaaaatgttgtatctgcaaatag

SEQ ID NO: 362776 - DNA, 468 bp, Homo sapiens
caacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactgtaggtgatgcttcacacgccctccagctgtgtcacttgcacgtccctggcagaatgattcactcctcgacctgtgttgtgttctgcattgaatcatattagcttagctcacaagtgcgtgcagggcgactatgcggaaaatggctcaaaaactaccactctgcttctgcctactaatggggaactagtggattgggtgtctggaatgtctccttccttacgtgcatg

SEQ ID NO: 362777 - DNA, 227 bp, Homo sapiens
taaaaatcagcctttaggttttaagttatggtaaagtctgtgtatatgttgacgttttaatagagattatctggttttgttttttgtacacaatagtacagggaaacccaaacatgagtggtttctccagaaagattccgaaggggacacaccttcacttatcaactggccttccaggtacccgcacgccggccctctggggcttgtgtgcatgagtgttgcttcct

SEQ ID NO: 362778 - DNA, 8212 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttcta

SEQ ID NO: 362779 - DNA, 8355 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362780 - DNA, 8061 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatctattgttgctgcaagttctggatcaaaggtatcatctgtgaacctcaagagcaggctg

SEQ ID NO: 362781 - DNA, 8919 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggttggtacctgaaaaataaaaatgctttagctaacatctcctttacgcaccggaggagtgttcttcctgacgtcagtcacaaagcttctcaaaagccaggtgttgcattcaagtgagaagggataggtaggatttcttttcctgaatgtctctcaaacaagctttcattacatgtttaaatgggatactttaggactatgacctacaccccagtgtttaggtcctgggttccttcctactcctgtgtaaaaaaggaagcggccccactttaaagtcctttatcccaggtagctctgaagttctgccatagacctgttgaatgagactgtcatggggtaaagcccaaagaatagtgttttttaaaagcatcacatgtgacctattgaagatggagaactattgctctaaagaattgatactccctggtctttcagttacattttcttgaggtcattgaaaatacccagtaaccagcatccacccacacccgtggtcacaaggctttccttgcaggcacactgtttctcctctctggttttgacatgtgccactctgtctagccaagggcttttctacccaggcaattgtgttcctctcttttttaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362782 - DNA, 8269 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaaggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362783 - DNA, 4210 bp, Homo sapiens
aggctctagctgtgttgatagcattggaagagtctgcctactcagtcagcattgtgcctggtagtggcacgactttgggactgggggtaagcaaatttgagcagaggtccaatcttccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362784 - DNA, 1983 bp, Homo sapiens
  misc_feature (58)..(58): n is a, c, g, or t
tctctagacggatcccggttgcacggggaggcgggaagaggaagacgaacatgtgcanagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362785 - DNA, 1951 bp, Homo sapiens
ggtgagtgttctatttgtgtcttttgcacattttattgatatttattttttccttatgtatgtcccttcatgtattaaggatattaactagttgctgtattacaaatatttcccatttgttacttggtttttcttttctttttaattttgcattgtttttcatttttatataattaatgcattattttcccttttgattggttcttttactattgcacttgaaaaggctttctccaccttgaagctcagataaatcctacctgtgtttccacagtgctttgaattatttcatattttacattcattcttcatctggaatttactttgatgcacatgatatcttcagctttgttctcttttctttcaaagatcctggaagttttaacttcgcgccccgcctgttcatcctcagcagctcctctggggattttgcagccacagagtttgtgtaccctgcccgagccccctctgtggtcagttccatgcccttcctgcaggaagatctgtacagcgcgccccagccagcacttttccttgttgacaatcaccacgaggtgtacctctggcaaggctggtggcccatcgagaacaagatcactggttccgcccgcatccgctgggcctccgaccggaagagtgcgatggagactgtgctccagtactgcaaaggaaaaaatctcaagaaaccagcccccaagtcttaccttatccacgctggtctggagcccctgacattcaccaatatgtttcccagctgggagcacagagaggacatcgctgagatcacagagatggacacggaagtttccaatcagatcaccctcgtggaagacgtcttagccaagctctgtaaaaccatttacccgctggccgacctcctggccaggccactcccggagggggtcgatcctctgaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatatatatttttggactggtgtttttcacaaagtatttttcaatcagagttttcagaacctgacattgttaaagatactgcttgtcccggagttgtgtattttgtaaatgttcaagggaactgtttggaaacttctttccaccattcaggaggttatcagaattaataaaagtatctgttatgtgcacttaagccgcagctgctatagatagcactgccttcttgttccagctaggcaatgcctttttttttttttttgaagcagttctctttataaagtgttattttgatagtttgtggattctaaaatatatatatatttatataaacaccatataagtcaaatatgtatttaacaaagcaatatgtattcattcactttcaagatttgttttggtgtcaaaataacatgaaaaggtagatggagttgcttctgttgaattagctctgccaccaatatgtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaattttactctcaaatagtcaaaataaaaacatctcaatttctaataccggttgtaaacaaacagtacacatgtcattttgtgatataggactcccaaataaaagtatcagaataaacacaacaattaactggtaaaaaaaaagaa

SEQ ID NO: 362786 - DNA, 7032 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaaagtcgagagagccaaatgacgattgaggagaggaagcagctcatcactgtgagagaggaggcctggaagacgagaggcagaggagcggccaacgactcgacccagttcactgtggctggcaggatggtgaagaaaggtttggcgtcacctactgccataaccccagtagcctcagccatttgcggtaaaacaagaggcaccacacccgtttccaaacccctggaagatatcgaagccagaccagatatgcagttagaatcggacctgaagttggacaggctggaaacctttctaagaaggctgaataacaaagttggcgggatgcacgaaacggtgctcactgtcaccggcaaatctgtgaaggaggtgatgaagccagatgatgatgaaacctttgccaaattttaccgcagcgtggattataatatgccaagaagtcctgtggagatggatgaggacttcgatgtcattttcgatccttatgcacccaaattgacgtcttccgtggccgagcacaagcgggcagttaggcccaagcgccgggttcaggcctccaaaaaccccctgaaaatgctggcggcaagagaagatctccttcaggaatacactgagcagagattaaacgttgccttcatggagtcaaagcggatgaaagtagaaaagatgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggaagaagacatgtgcagaccaggctggtggaacctcgagcttcggcgctcaacagtggggactgcttcctcctgctctctccccactgctgcttcctgtgggtaggagagtttgcaaacgtcatagaaaaggcgaaggcctcagaacttgcaactttaattcagacaaagagggaacttggttgtagagctacttatatccaaaccattgaagaaggaattaatacacacactcatgcagccaaagacttctggaagcttctgggtggccaaaccagttaccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtttgattttggtagtgaagtttacgtatggcatgggaaagaagtcacattagcacaacgaaaaatagcatttcagctggcaaagcacttatggaatggaacctttgactatgagaactgtgacatcaatcccctggatcctggagaatgcaatccgcttatccccagaaaaggacaggggcggcccgactgggcgatatttgggagacttactgaacacaatgagacgattttgttcaaagagaagtttctggattggacggaactgaagagatcgaatgagaagaaccccggggaacttgcccagcacaaggaagaccccaggactgatgtcaaggcatacgatgtgacacggatggtgtccatgccccagacgacagcaggcaccatcctggacggagtgaacgtcggccgtggctatggcctggtggaaggacacgacaggaggcagtttgagatcaccagcgtttccgtggatgtctggcacatcctggaattcgactatagcaggctccccaaacaaagcatcgggcagttccatgagggggatgcctatgtggtcaagtggaagttcatggtgagcacggcagtgggaagtcgccagaagggagagcactcggtgagggcagccggcaaagagaagtgcgtctacttcttctggcaaggccggcactccaccgtgagtgagaagggcacgtcggcgctgatgacggtggagctggacgaggaaaggggggcccaggtccaggttctccagggaaaggagcccccctgtttcctgcagtgtttccagggggggatggtggtgcactcggggaggcgggaagaggaagaagaaaatgtgcaaagtgagtggcggctgtactgcgtgcgtggagaggtgcccgtggaagggaatttgctggaagtggcctgtcactgtagcagcctgaggtccagaacttccatggtggtgcttaacgtcaacaaggccctcatctacctgtggcacggatgcaaagcccaggcccacacgaaggaggtcggaaggaccgctgcgaacaagatcaaggaacaatgtcccctggaagcaggactgcatagtagcagcaaagtcacaatacacgagtgtgatgaaggctccgagccactcggattctgggatgccttaggaaggagagacaggaaagcctacgattgcatgcttcaaggtaatgtggcatccacagtctgcgatctggtttttttgtttgtttttggaaacaagagtcttgctctgttatccaggctggagtatagtggtatgatcacagctcactgcagcttcaacctcctgggctcaagtgatcagcctgcctcagcctctcaaagtgcaggcttgagccactgtgccccattcatgttttatcttaattcttcagtgtgtcttaaatctagtgtgatgagtattatgtccagctgattgaacagtttttttcttcccaggggtgagtttaacttggacaccagga

SEQ ID NO: 362787 - DNA, 3343 bp, Homo sapiens
  misc_feature (3218)..(3218): n is a, c, g, or t
  misc_feature (3221)..(3221): n is a, c, g, or t
  misc_feature (3224)..(3224): n is a, c, g, or t
  misc_feature (3278)..(3279): n is a, c, g, or t
  misc_feature (3282)..(3282): n is a, c, g, or t
  misc_feature (3290)..(3290): n is a, c, g, or t
  misc_feature (3298)..(3298): n is a, c, g, or t
  misc_feature (3304)..(3304): n is a, c, g, or t
  misc_feature (3316)..(3316): n is a, c, g, or t
  misc_feature (3323)..(3323): n is a, c, g, or t
  misc_feature (3332)..(3334): n is a, c, g, or t
  misc_feature (3339)..(3339): n is a, c, g, or t
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccaggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccacattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgattctgatgtaaactgtaaagtaacaaatgtaaatgtaagacagtggtaactgtggaataaataccaaagagggcgaagaggaaagctcttcagaattggaagttcagtctcacaatgcacgtagagccttccctactgtattagtcggttctcacactgctatgaagaaataccggagactaggtaatttataaaggaaaatatttcaattgactcacagttctgcatggctggcgaggcctcagaaaaacttacaatcatgcagaaggcacctcttcacagggcggcaggagaatgagtgcccagtgaagcggggaagccccttataaaaccatcagctcttgtgagaactaactcactatcacaagaacaatggggaaaactgcccccatgattcatttatctccacctggtttcgctcacacacgtggtgattatggaactacaattcaagatgagattggttgggaacacaaccaaaccatatcacctaccgttgagggggaggtgaaaagagtcccatgcccagtgttcctggcaagaatgaatctgtgtctataggagtgtgcacctgtagtctccctatcacaagcaactgcacgtggcccatctgtattactgttctctgcagtgacctctggttccaattacctttccagctccctgtccttccatgaaccctggtagcactggctggggccctgtttgttctagtctcttccccaggacagatggatacttgaataaacatgttggatacaaatagcgcacccaaactctccttagaaatctcattttgtgccctgcatgttcagcccagatagaatctccacagaccagaccagctggatcagactcagctctaccctagcttagtggtttggaccacaggtcctcctgtggaggaggggtctccagccactttccccagctctctcccctccactctaagtcaacattggttccaattacctccctcctcctcattaggagcccacagtactgataatgaccattttaaatatctttttctaaaaatatcaccaaaaacaagaaaggcacaagatagaaggcccaaagaaaatacgaaacatgtagctttaaatttttcatccttcaaaggaaggaccaaagataattaaaatattagtgaaggaagtacaggtagataaaaataggtatttacatatatgctgcccctttgggggggactttcaattttaaaaacttagctgataaaaacntanagntggccgggcgcggtggctcacgcctgtaatcccagcactttgggaggccgaggnnggnggatcacnaggtcagnagatcnagaccatcctgnctaacanggtgaaacnnngtctntact

SEQ ID NO: 362788 - DNA, 4387 bp, Homo sapiens
ttcactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgctatttgggctaacttttgggattttactttgtgcttagaatttgaaagtagtattcattggaaagagactccaagaaaatactcgaagacatcaaaagctggattcgagggtataacgtgttttgttttgttttttaaattagaaaaataaggaattgcagtgtgattttctttccccctttaacttagaggaacgaggattatacagaaatttgaaatttcaacaagaaaaacttaagcttccttggattcccacgtcaaaggaaagtttcaagctttcagaaggagttctcactcgaagataaagaacagctcgctaaccacgaaagaggaatcgatgctcagcttttagttgcacttcctaaagttgcagaattaagacaaatctttgaaccaaagaagaaagaattcttagaaatgaaaagaaaagaaagaattgccaggcgcctggaagggattgaaaatgacactcagcccatcctcttgcagagctgcacaggattggtgactcaccgcctgctggaggaagacacccctcgatacatgagagccagcgaccctgccagcccccacatcggccgatcaaatgaagaggaggaaacttctgattcttctctagaaaagcaaactcgatccaaatactgcacagaaacctccggtgtccacggtgactcaccctatggttcgggtaccatggacacccacagtctggagtccaaagccgaaagaattgcaaggtacaaagcagaaagaaggcgacagctggcagagaagtatgggctgactctggatcccgaggccgactccgagtatttatcccgctataccaagtccaggaaggagcctgatgctgtcgagaagcggggaggaaaaagtgacaaacaggaagagtcaagcagagatgcgagttctctgtaccccgggaccgagacgatggggctcaggacctgtgccggtgaatccaaggactatgccctccatgcgggtgacggctcttccgacccggaggtgctgctgaacatagaaaaccaaagacgaggtcaagagctgagtgccacccggcaggcccatgacctgtccccagcagccgagagttcctcgaccttctctttctctgggcgagactcctccttcactgaagtgccacggtcccccaagcacgcccacagctcctccctgcagcaggcagcctcccggagcccctcctttggtgacccacagctatcccctgaggcccgacccagtacagggaaacccaaacatgagtggtttctccagaaagattccgaaggggacacaccttcacttatcaactggccttccagagttaaagttagagaaaaattggtgaaagaggaaagtgctcgaaacagccctgaactcgcctcagagtccgtaactcagaggagacaccagccagcgccagtccattacgtgtcatttcagtctgagcactcagcctttgatagggtccccagcaaggcagcaggctctacacgacagccaatccgtggctatgtccaacccgcagataccggtcacaccgccaagctggtgacgccagaaaccccagaaaatgcatctgagtgtagctgggtagcatcagccacccagaatgtccccaaacctcccagcttgacggttctagaaggtgacggaagggatagcccagttctccatatctgcgagtcaaaagcagaagaagaagaaggggaaggagaaggagaagaaaaagaagaagatgtgtgcttcactgaagctctcgagcaaagcaagaaaaccctactggctttggagggtgatgggctagtgagaagcccagaagatccctctagaaatgaggactttggtaagcctgctgtgagcacagtcaccttagagcatcagaaggaactggaaaacgtggcacaaccccctcaagctccgcaccagcccactgagaggacaggcaggagcgagatggttctctacattcaaagtgagcctgtgtcccaagacgccaaaccaactggtcacaacagggaagcctcgaaaaagcgcaaggtccgtacccgctctctgtcagatttcacaggcccccctcagctccaggccttgaagtataaggacccagcttccaggagagagctggagctgcccagctccaagaccgaagggccttatggggagatcagcatgctggacacaaaggtctctgtcgcccagctccgaagtgcgttcctggcatctgccaacgcctgcaggagacctgaactcaaatcacgggtagagaggtcggctgaaggacctggcttgcccaccggtgtggaacgggagagagggtcccggaaaccaagacgctatttttctcctggtgaaagtagaaaaacttccgagagatttagaacccaacctataacttcagcagaacgaaaggaatcggataggtgcacttcacattcagaaacgccaactgtcgatgatgaagaaaaggtggatgaacgagccaagctgagcgtcgccgccaagaggttgcttttcagggagatggaaaaatcttttgatgaacaaaatgttccaaagcgacgctcaagaaacacagctgtggagcagaggctacgccgtctgcaggacaggtccctcacccagcccatcaccactgaagaggtggtcatcgcagccactgaacctatccccgcttcgtgttctgggggcacccaccctgtaatggcgagacttcctagccccactgtagctaggagcgctgtgcagcctgccagattgcaggcctctgctcaccaaaaggccttagccaaggaccagacaaatgagggcaaagagcttgctgagcaaggagaacctgattcctccactctaagcttggccgaaaagttggccttgtttaacaaattgtcccagccagtctcaaaagcgatttctacccggaacagaatagacacgagacagaggagaatgaacgctcgctatcaaactcagccagtcacactgggagaggtggagcaggtgcagagtggaaagctcattcctttctcacctgccgtgaacacatcagtgtctaccgtagcatccacggttgctccaatgtatgccggagatcttcgcacaaagccacctcttgaccacaatgcaagtgccactgactataagttttcttcttcaatagaaaattcggactctccagttagaagcattctgaaatcgcaagcttggcagcctttggtagagggtagcgagaacaagggaatgttgagagaatatggagagacagaaagcaagagagctttgacaggtcgagacagtgggatggagaagtatgggtcctttgaggaagcagaagcatcctaccccatcctgaaccgagccagggaaggagacagccataaggaatctaaatatgctgttcccagaagaggaagcctggaacgggcgaaccctcccatcacccacctcggggatgaaccgaaggaattttccatggctaaaatgaatgcacaaggaaacttggacttgagggacaggctgccctttgaagagaaggtggaggtggagaatgttatgaaaaggaagttttcactaagagcggcagagttcggggagcccacttccgagcagacggggacagctgctgggaaaactattgctcaaaccacagcccccgtgtcctggaagccccaggattcttcggaacagccacaggagaagctctgcaagaatccatgtgcgatgtttgctgctggagagatcaaaacgccgacaggggagggccttcttgactcacccagcaaaaccatgtctattaaagaaagattggcactgttgaagaaaagcggggaggaagattggagaaacagactcagcaggaggcaggagggcggcaaggcgccggccagcagcctgcacacccaggaagcagggcggtccctcatcaagaagcgggtcacagaagtggtattcagtgaatctaggaagacagcagcagacatgtattccaggaaccagtgtttgatgaagctaggactgaggagcaagcgacaatctacattctgtcg

SEQ ID NO: 362789 - DNA, 280 bp, Homo sapiens
acttatggaatggaacctttgactatgagaactgtgacatcaatcccctggatcctggagaatgcaatccgcttatccccaggtactcctgccgccgcccggggacagctcttcaagcgagctgattcccttcgatccctctgttctcaccacagtcctctactctcgctctttatagggttcagttttcataaacgattatatgcagtggactgtgaatattcacaaaaggaacagttctttaacttttatctaactattgcagaaatatggatgtcgt

SEQ ID NO: 362790 - DNA, 246 bp, Homo sapiens
catgggcacccaggtgtgtgctgtgtgcagtagagtgtcattctgtgtgtaaatacatgtctttacttgaaatctgcacctctcatccatgtgaccttcttgtaggccgatcaaatgaagaggaggaaacttctgattcttctctagaaaagcaaactcgatccaaatactgcacagaaacctccggtgtccacggtgactcaccctatggttcgggtaccatggacacccacagtctggagtcca

SEQ ID NO: 362791 - DNA, 6299 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgga

SEQ ID NO: 362792 - DNA, 4054 bp, Homo sapiens
  misc_feature (1426)..(1426): n is a, c, g, or t
  misc_feature (1483)..(1483): n is a, c, g, or t
  misc_feature (1834)..(1834): n is a, c, g, or t
gaattcgcggccgcgtcgaccaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaagaactggaaacagccatgccctgttttctgtgtatttgggatgggaataacaacattttgggggagctttttaaatctcagagaanaggaaagtggcctgctctggcaggtatgtgcagtgtttcatttgttccagtcccaanaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgngggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactataaaaaaaagtcgacgcggccgcgaattccagctgac

SEQ ID NO: 362793 - DNA, 2036 bp, Homo sapiens
cgaacagtccatgctctaccctggctcctgtctggcagaggagacagacattacacacgatttcagacccagcaggctgtgggctgctcataagcgagggatactggatgcagaggagggaagggatctgggaggtagatgtgggatcagacctgcatcttgaaggatgagtaggatgctgacgggcagagaaagcaggcagggcagaaagagcaagcaggggcttcctagcaggcaacacagcctggggaaaggcacagggcagccagatgctgggctgttgggcccagggcagtggcagatggggacagggagccggtagtgttatggttggtttgaaagacagggtctgcatccttggagaagagattaatgagacttgtcttcctcttttgtagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatggtaagtgtcgctcagccaggggatctaaaggctttcccagtttcctagatcctggagtccagatctaggggcttcagctgtgtgcagaccccatgccacttcagggaagtgacacaggcctgtgtcatctcgctttggcagcaggtgggtggccttcctcaggggaggaggtggcctgagatgtgtttcaggtctttgacccatcactccctacacacacgacgtgaacaccactcctggagcattctcagaatggagatttgaattccatgtggcagcttctcacacacaaacctgccatcattccccacacacccactcacgacattcaacagccatgagccaaaagaagttccttgtttcagatttgaaggttttatgaatccacttcttccggatgtagctctttaatgattttataaagaagaaagacttctgactctcctgtgtttattcaccagatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgga

SEQ ID NO: 362794 - DNA, 548 bp, Homo sapiens
aatgacttttccagaaatggaggcttcattgttcttacaaatggaggtttcatttgttctgtgtagaagaccttagacgctagacccctttctccttctcaacaaggctcttcagaacaaacagaactctctctggacataggcgggtggagtgttctagcccatctcacagcctgtgttttggccctaattctttcagcccattttcctgaatgaagtcttggtgaaactgcccacagacccttccagcgatgagcctgtcttccacatttcccacattgatcgggtctacaccctccgaacagacaacattaatgagaggtcagtcctgaccatgtgtggcctgccttgaactctgggagaaggcctggacgtctccctctgccataaacccatctccagccgtgcttaagccccactaattctgtatcctgaacctctcttaacacatcccctctgctccagtcccatggtaggccttggtcactgcagctgcctcctaacatgcttcccggcttctagtctctccccacaccactcagcagcct

SEQ ID NO: 362795 - DNA, 635 bp, Homo sapiens
  misc_feature (52)..(52): n is a, c, g, or t
  misc_feature (124)..(124): n is a, c, g, or t
tagattcgcatatatgtgcccaaaggaacgactccatgttttctaaaagccntagagaacatatatcgggtgcctctcctctgtccctttgtgttcgtcattttggcgaattactggaagatgncggttccggccgaaaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaagatttacctccatcgaccacagatgtactcagtcggccccgcgattcctcacacgcccaacgacttaactatcgagatttacctcctcggccagattaataccgggtaacgagctcgatt

SEQ ID NO: 362796 - DNA, 6250 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaaggtttcccccattttgttatatactcctaaaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgga

SEQ ID NO: 362797 - DNA, 6165 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaagctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgga

SEQ ID NO: 362798 - DNA, 3960 bp, Homo sapiens
taagaggctacagtgaaagagaggtcaatcttcatttcccatagccaaaagccagtaatgtctaaaattgaaaaaattcaagaaaaagcagtataaatatgttattcagaaatataaatggtgatatagaagaaaccaggaagaatggcaggtcaggagtgaaaatcagggcataaggagccatgagataggggaggattgttttccctcattagccatatataatgaatgctatttgtctttgtaaaatattttcatgtaacttggataaaattaaaattaaaaagacaacttgccagtcactggaaatagtagctgttaatttgtagaaaatgccttagctgtttagttagatgggcttaattctgaaaatgagaatactatacaatagttttcatctctttccattgtaaatgtgtgaatttctaagcactgttaatccttctttttatttccgtaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgga

SEQ ID NO: 362799 - DNA, 7249 bp, Homo sapiens
  misc_feature (4621)..(4621): n is a, c, g, or t
  misc_feature (4678)..(4678): n is a, c, g, or t
  misc_feature (5029)..(5029): n is a, c, g, or t
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaagaactggaaacagccatgccctgttttctgtgtatttgggatgggaataacaacattttgggggagctttttaaatctcagagaanaggaaagtggcctgctctggcaggtatgtgcagtgtttcatttgttccagtcccaanaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgngggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactataaaaaaaagtcgacgcggccgcgaattccagctgac

SEQ ID NO: 362800 - DNA, 5185 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggtcagtcctgaccatgtgtggcctgccttgaactctgggagaaggcctggacgtctccctctgccataaacccatctccagccgtgcttaagccccactaattctgtatcctgaacctctcttaacacatcccctctgctccagtcccatggtaggccttggtcactgcagctgcctcctaacatgcttcccggcttctagtctctccccacaccactcagcagcct

SEQ ID NO: 362801 - DNA, 3536 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcaacatatgctgaagttacctgagc

SEQ ID NO: 362802 - DNA, 995 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatggtaaagtgttttgtagatgaacctaattttctgatagtattttgtttttttgtaatatagtgttaacataaaattgtttttagttgcattctattggttattaagaatatttctgccagcactttgggagtctgaggtaggaggattgcttgaggccaggctgggcaacatagtgagaaccctgtctctacagaaaattaaaaaaaaaattagctgggtgtggtggccacacctctagtcccagctactcagggaggccaagatggaaggattgcttgagcccaggaattcagtgctgcagtgaactatgattgtgtcactgcaccctagcctggatgacagaatgagactctctttagaaaa

SEQ ID NO: 362803 - DNA, 257 bp, Homo sapiens
aaaaaaaaaaaattctgtacgtagtttaattggctttttatctgccttatcttacagtgtgggaatatggatgactctgttcttcagtgccttttgtctctgctaagctgtctcaacaacctcttcctcttacttaaggttattttctaatatctagcttcttttctttgagttactttgctgttttatttttttaaaactagactattctttgcctttatctgagtatctttgtttgaaataacatatacaatata

SEQ ID NO: 362804 - DNA, 266 bp, Homo sapiens
ttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccaggtgggtgaagccgctagcggggctgcagcaaggcgcggggcaggtgcgggcg

SEQ ID NO: 362805 - DNA, 608 bp, Homo sapiens
gatccttgttgtacctacccagctttttatagatgaatcacctgtttgtagttcttgtaatagtcaatgaaagctagttaaattatagattaccatttgtgtttctttggcccttttaagtattatttttcattttgttacataattagaactttttttaagatagagaattttaacagttcaaatttgtttagttgatgttgcatgttgttactagtcaaattttatctcacccacctaatttgcattatgttcattttattcctcattttctttttttaggacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggag

SEQ ID NO: 362806 - DNA, 6218 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgga

SEQ ID NO: 362807 - DNA, 4779 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaagtgtgggaatatggatgactctgttcttcagtgccttttgtctctgctaagctgtctcaacaacctcttcctcttacttaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtgaggaggctgctgctggctagctctcggggtatctgctgtctctcatgagagatggtgggcatcagactcagggctgcctccacgcagagtcaaagcaaggcatcacttttgatgtgtgaattcacaaatagtgacggaagctctcacatcctccaaatgctgtctctgcctgccggataatgcttgagattgaaagtctctaatgagctctttcccccagatgaggtcactcagagtgaagcgggagaacaagagggcattcgcatggcttcgttggatgtggcaggagccccatcaaggaaggacggggatagagtggatgggaagggcctatggcagaccgtagcttccttggatatttgcctaatatctgttttaacatctgacattttcataaactggtatctctggaggaactgtgaaacagtgaaagtgttcacctcatggttgtatcagtttggaaaacccaatgggagcatattgtaaaatagttcccaaatatcatatagctactgtttgtttataccagtgacctctacgctgatgacagctatccttattcgagtagcactttaaaatgatttgtgcttgagtgaacaaaagaagactttccatttctactatacctttgtt

SEQ ID NO: 362808 - DNA, 640 bp, Homo sapiens
tgaaccacctcttaaaagcttctaatgcagtttctcctccctgcacccccaatgttaaaaataaaaccataaaaaattattcactgaatatctattttgtaccagaactacaaaaacaagtttatgatcttcaaatactccaaaatctgttctgaacaagctgggaaatggtctttcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggtcagtcctgaccatgtgtggcctgccttgaactctgggagaaggcctggacgtctccctctgccataaacccatctccagccgtgcttaagccccactaattctgtatcctgaacctctcttaacacatcccctctgctccagtcccatggtaggccttggtcactgcagctgcctcctaacatgcttcccggcttctagtctctccccacaccactcagcagcct

SEQ ID NO: 362809 - DNA, 6679 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatggtaagtgtcgctcagccaggggatctaaaggctttcccagtttcctagatcctggagtccagatctaggggcttcagctgtgtgcagaccccatgccacttcagggaagtgacacaggcctgtgtcatctcgctttggcagcaggtgggtggccttcctcaggggaggaggtggcctgagatgtgtttcaggtctttgacccatcactccctacacacacgacgtgaacaccactcctggagcattctcagaatggagatttgaattccatgtggcagcttctcacacacaaacctgccatcattccccacacacccactcacgacattcaacagccatgagccaaaagaagttccttgtttcagatttgaaggttttatgaatccacttcttccggatgtagctctttaatgattttataaagaagaaagacttctgactctcctgtgtttattcaccagatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatgga

SEQ ID NO: 362810 - DNA, 6483 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggtgcagatgattggggacatcctggccgctgagctgtcccacatgcaggcttacatcaggttctgcagctgccagcttaatggagcagctctgttacagcagaagacagatgaagacacagatttcaaagaatttttaaagaagctggcatctgacccgcggtgtaaaggaatgcccctctccagcttcctgctgaaacccatgcagaggatcacccgctacccactgctcatcagaagtattctggagaacaccccggagagccatgcagaccattcctccctaaagctggccctcgagcgggcagaggagctgtgctctcaagtgaatgagggagttcgggagaaggaaaactcggaccgactggagtggatccaggcgcacgtgcagtgtgaaggcctcgcggagcaacttattttcaactctctcaccaactgcctggggccccggaagctcttacacagtgggaaattatacaagaccaagagcaacaaggaactgcacggattcctcttcaatgacttcctgcttcttacctacatggtcaagcagtttgctgtttcctctggctctgagaaacttttcagctcgaagtccaatgctcaattcaaaatgtataaaacgcccattttcctgaatgaagtcttggtgaaactgcccacagacccttccagcgatgagcctgtcttccacatttcccacattgatcgggtctacaccctccgaacagacaacattaatgagaggaccgcctgggtgcagaagatcaaggcggcgtctgagcagtacatcgacaccgagaagaagaagcgtgagaaagcttaccaagcccgctcccaaaagacttcaggcattgggcgcctgatggtgcatgtcattgaagctacagaattaaaagcctgcaaaccaaatggaaagagcaacccatactgtgaaatcagcatgggctcccagagctacaccaccaggaccatccaggacacactcaatcccaagtggaattttaactgccagttctttattaaggatctctaccaagacgtgctgtgtctcaccctgtttgacagagaccagttttcaccagatgatttcctgggtcgtactgaaattccagtggcaaaaattcgaacagaacaggaaagcaaaggccctatgacccgccgactgctgctgcatgaggtccccaccggggaggtctgggtccgttttgacctgcagctttttgagcaaaaaactctcctgtaggggttctaaaggacagcaccagcgggacagcccacaaggctggggctggagaatgagagactgcgctctcttggggctgagggagcaccatgcagcttcacccctcacaaagccatgcacgctgggggctctgttttcctgcacactaaatagctagcaatctatgcaaacacctttcccataaagaaaccaaaccccatagtacagtgccttgtcctagtgttcacatgttcagctctgtttgtttagatgccaaggtttccattttcagggctataaaaagtattacttggaaatgaggcatcagaccaccagatgttaccgctcggttgaatgtgtccaccgtggagtggtttggtgacgctgtaaccattccacgccagtgacctctgctgggtcacagccactcaggaggggaagggtcaggatgagaggctgcagcctcgacacttggcgcggcctgatactgaaatagcgtctactcgtgcactgaataaaaacagaaacttgatcattttattcctgattagattttatcactctctgctaagacaatatagtctggagtataagtgggaaagcttgatttaaatactgtgaactctaataatgtggaaaatatttttcaactttaattttctgaagtataaattatttatgtaaattcattgtttttgcatatttcttaggacatgcatctttaagctttatcattgcccatatgtacagaaagagaataaagacatatgtttatggatggaacttcgtcaaagtctgactgatttactttctatatgaaagctgctttttttctttttaattttctcagccagatgaaaggctcttaaaaggtaccttcacaagttgcctataatgaaaccaagtttccttcctggtacgtgggaaaaccaaggacagagtgaggatgaggtcaggagacccagggcctcatcttgactctgccactaatttgctctgtgactttggtgaatctacctcgtgtttctggggctgggtttctttaat

SEQ ID NO: 362811 - DNA, 7214 bp, Homo sapiens
  misc_feature (4621)..(4621): n is a, c, g, or t
  misc_feature (4678)..(4678): n is a, c, g, or t
  misc_feature (5029)..(5029): n is a, c, g, or t
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaagaactggaaacagccatgccctgttttctgtgtatttgggatgggaataacaacattttgggggagctttttaaatctcagagaanaggaaagtggcctgctctggcaggtatgtgcagtgtttcatttgttccagtcccaanaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgngggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttccaaaatacatcacattattaggatgtagggagataagtatgtgtgctccctagggtggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactata

SEQ ID NO: 362812 - DNA, 7160 bp, Homo sapiens
  misc_feature (4621)..(4621): n is a, c, g, or t
  misc_feature (4678)..(4678): n is a, c, g, or t
  misc_feature (5029)..(5029): n is a, c, g, or t
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtgacccaatgttgtcttccagttgtgaaagcaccccagagacccactatccaagtttcactctagcgtggaggcagggcaggcagccctgatcaaatatctcctacacaattcgtttacttcgtttgaatgttagagccacttgtgattatttttttgtgtttctaacttacagtttaaatttatttgtaaaaagttaaaggatagtgggtctttgtgtggctttccctgctgttcactctggcatctttagcatttttcttcttttttaatttgataattgtaggtcattagcatgcatattgagtttgcccttatgtggtgggagttcaaacacacaaagacccactatttgcacaaactattcttactggtttggaataggctgccatgcttttttaatgttattgcaacatgtgtattcatttacagaattcagataaaatttgcttatgttctgctattatgtttgatctaatcctaatcacagtgagctcttaattagctcaatatgtggtttgccctcaagtgtgcactgtttattactttgtaatatgccactatgagtactgacatttagatatgtttaaaggccaagaactggaaacagccatgccctgttttctgtgtatttgggatgggaataacaacattttgggggagctttttaaatctcagagaanaggaaagtggcctgctctggcaggtatgtgcagtgtttcatttgttccagtcccaanaatgagcactgtcctatggtagttcgcttaggatctttatgtgctctgggctaatgaaggtactgcatcatgtgctgcagcgtgtgtattctttttcgatgacctataaagggattatttttgaggaatgaaaggctcccatcattgactgtgagatgggaaaaacctttcctagcttagagcatttatatcttaatccattttaaagtcagagttcattgttacctgttttaatcaggtgactacatgtcccagtatacaaaggggcactggttgacattcttcttaatgtatttagtaaatatcataagaaatcctttaagagtttaaatgtccccaaaacagacatgngggctctagtcaagaatgaattagagtgaaggaaagctgtgtaacacctggcattcctctgtgttcatggagcttctttgaggctctaagattgattttaccatcagacttctctaatacctgttcttcaaccatattggctactttgacataagaatttacttcttttcctggaatggaaaacactttaaaaaataataacaaacattattataaactaatatatgtgagagtacttagttgatacaaaaaggagttttagtagacagtattatactatatttgaaaatcaaggagaattttatgcaacttaaaatgtttacaaactgcagtgcaatctactgtttgtgaatgtcaaagtatcaggaaaagtgtatatacaatcacagagtcatatttcctcacaaagttatttacaaagagtgaaatatgtttttgtacctctcagtttcagttagaggcatattttgtgcaatatttatgttaatgtgcctatacattatgaatgaattatttcagtcatacattgcctaaatcataactttatgatgcttgggaaagaatcaacagttaaaacttcataaagttctaatgtctgtgttcctggcaatttctagttactagaccacctctatttttagcatttggcatcctcatgatacttttataaatatgacattaataggaaagcaataatttcattttacagatagaataacagatttgcctgcattcactgaaagagtgcaaagactgggtccttgtgaattcaactgactctcccaaattgtattaattacctgttcttgccttttattttctgaacttgctgcttttgcattcttttgagttcaaagacagttactttaaatccatttttaaaccctcggggtagaaatcataccactgttaatcagccacattatttggtctaaggttttttctttataattctgaaactgagtttatctaatacattgatgaattatttcaaacgtatttttatagttcaaatcagttcacttttacactgataaatataaattactaggaatgaccttcagacagcgtttagcatctgtaaccaacctgaaaataatatgttcatcaggtacctatggattaaatcatatactggcgtatttaagctgaatgtcagtctggaaaataaatttactatattaactgaaataccactctttgtgtaggtattttgtcatgtatttaagaaaaagataaaaagaatggaaatcatatgacataataacttaagtctttcttaaaagtgcatgctgtcttttgcaatacctcattcagccaagtatttgttctcttcctcattcagtataagtcagctttcaatttgcttagaaggcaacattagaaggttagagttcatcagaaacatagaattttaaaatgtgagttcaactgaataaatttgaatttctgtaggaggtaaagaatcaaaatacctgtttaaagattgcaattgcaatgtataataatcacttttaaattatttgattaaaccttttaggttttccagaaatgaaaaaaatcagttctaaaaccaaagctgatttttagaaaatttgagaatgtaaatcagccctatccataatatagtttctctaaaactttatcttaaagagtcattttaaaataatataactattaaaaatgtaactgatatttaaatgttttgaaataaaacattttaaaatataaatactgtagtttaaaagaaagaaactgggggaaagaaaagtagagaaagaaataccaattccagtccaaagctttatttgccaggttttcttagaatgacttttaccagtttatgaattcttgtaaacagaatctataatggaaatactgaaagacttttgcctaaagtggcattattgaatgctgctgtgatgctactgtaatgtaataaattattaaattgttgcaaagtgctgtttttgccttaaaattttattttgtgtgtcttgaaaattatagtattaaaggtattgagattgtgcaaatgctgggcacgcttggcatgagataatctgtttttatttttacaaaattgtaatataactatgcaagtgtgtttattaaaagaacacaaactata

SEQ ID NO: 362813 - DNA, 4358 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcagaggaggaaagcaaattgattccattaatggaactctgccttcatatcagaaaatgcaagaagaggagcctcagaagaaattaccagttacttttgaggacaaacggaaagccaactatgagcgagggaacatggagctggaaaagcgacgccaagccttgatggagcagcaacaaagggaggcagaacgtaaagcccagaaagaaaaggaagagtgggaacgaaaacagagagaattacaagaacaagaatggaagaaacaacttgaattagaaaaacgcttagagaagcaacgggaattggagagacaacgagaggaagaaaggagaaaagacatagaaagacgagaggcagcaaaacaggaacttgaacgacaacgtcgcttagaatgggagagaattcggcgacaggagcttctcaatcaaaagaatagagaacaagaagaaattgtcaggttaaactctaaaaagaagaatcttcatcttgagttggaagcactgaatggcaaacatcagcagatctcaggcagacttcaggatgtccgactcaaaaagcaaactcaaaagactgagctggaagttctggataagcagtgtgacttggaaattatggaaatcaagcaacttcaacaggaacttcaggaatatcagaataagcttatctatctggtacctgagaagcaattattaaatgaaagaattaaaaacatgcagttcagtaacacacctgattcaggggtcagtttacttcataaaaaatcattagaaaaggaagaattatgccaaagacttaaagaacagttagatgctcttgaaaaagaaactgcatctaagctgtcagaaatggattcttttaacaatcaactaaaggaactgagagaaacctacaacacacagcagttagcccttgaacagctttataagatcaaacgtgacaagttgaaggaaattgaaaggaaaagattagaactaatgcagaaaaagaaactagaagatgaggctgcaaggaaagcaaagcaaggaaaagaaaacttatggaaagaaaatcttagaaaggaggaagaagaaaaacaaaagcgactccaggaagaaaaaacacaagaaaaaattcaagaagaggaacggaaagctgaggagaaacaacgtaaggataaggatactttgaaagctgaggagaaaaaacgtgagacagctagtgttttggtgaattatagagcattatacccctttgaagcaaggaaccatgatgagatgagttttaattctggagatataattcaggttgatgaaaaaaccgtaggagaacctggttggctttatggtagttttcaaggaaattttggctggtttccatgcaattatgtagaaaaaatgccatcaagtgaaaatgaaaaagctgtatctccaaagaaggccttacttcctcctacagtttctttatctgctacctcaacttcctctgaaccactttcttcaaatcaaccagcatcagtgactgattatcaaaatgtatctttttcaaacctaactgtaaatacatcatggcagaaaaaatcagccttcactcgaactgtgtcccctggatctgtatcacctattcatggacagggacaagtggtagaaaacttaaaagcacaggccctttgttcctggactgcaaagaaagataaccacttgaacttctcaaaacatgacattattactgtcttggagcagcaagaaaattggtggtttggggaggtgcatggaggaagaggatggtttcccaaatcttatgtcaagatcattcctgggagtgaagtaaaacgggaagaaccagaagctttgtatgcagctgtaaataagaaacctacctcggcagcctattcagttggagaagaatatattgcactttatccatattcaagtgtggaacctggagatttgactttcacagaaggtgaagaaatattggtgacccagaaagatggagagtggtggacaggaagtattggagatagaagtggaatttttccatcaaactatgtcaaaccaaaggatcaagagagttttgggagtgctagcaagtctggagcatcaaataaaaaacctgagattgctcaggtaacttcagcatatgttgcttctggttctgaacaacttagccttgcaccaggacagttaatattaattctaaagaaaaatacaagtgggtggtggcaaggagagttacaggccagaggaaaaaagcgacagaaaggatggtttcctgccagtcatgttaaacttttgggtccaagtagtgaaagagccacacctgcctttcatcctgtatgtcaggtgattgctatgtatgactatgcagcaaataatgaagatgagctcagtttctccaagggacaactcattaatgttatgaacaaagatgatcctgattggtggcaaggagagatcaacggggtgactggtctctttccttcaaactacgttaagatgacgacagactcagatccaagtcaacagtggtgtgctgatctgcaaaccctggacacaatgcagccaattgagaggaaaagacagggctatattcatgagctgattcagaccgaagagcggtacatggctgaccttcagctcgtcgtcgaggtttttcagaaacgcatggcagagtcaggctttctcactgaaggggagatggccctgatttttgttaactggaaggagctcatcatgtccaacacaaagctgctgaaggctttgcgggtgcggaagaagaccgggggcgagaagatgccggcttctttaaaaattctttgaaatctggtgtcttcatctgtcttctgctgtaacagagctgctccattaagctggcagctgcagaacctgatgtaagcctgcatgtggacagctcagcgccagatgtcccatcatgtgtcctctag

SEQ ID NO: 362814 - DNA, 1861 bp, Homo sapiens
gcttcggacccgaccgactcggagcagaccttcagggttcaatgccccggaactcctggggcgaggagccacgcccgggcagtttcgggctccggagggtggggagtcggtgcccggcagcgggcgggccgtcagctgcccggcccggcgcctacctccccgccccccggcttcctgcggaggccgcggccgccatgttgttgtggggctgaggcggcgccggcggagccctgagcggctgtgacaggctacgcaacaggttcgcgggcggcggcctgacgaccaagccagctgcagtggcggcgacggcggcagagcagggtctccccgcgcctgcccgcgcccaggctgccggtgctgagggacgcggagtcgcgctgtgacgtgcgggaggcgcggcgagggcgccagatggctgagagctagcaaggaaaactcaggaccatgatggctcagtttcccacagctatgaatggagggccaaacatgtgggctattacctctgaagaacgtactaagcatgacaggcagtttgataacctcaaaccttcaggaggttacataacaggtgatcaagcacgtaattttttcctacaatcaggtctgccggcccctgttttagctgaaatatgggctttatcagacctaaacaaggatgggaagatggatcagcaagagttctccatagctatgaaactcatcaaactgaagcttcaaggccaacagttgcctgtggttctccctcctattatgaagcaaccccctatgttttctccattaatttctgctcgttttggaatgggaagcatgcccaatctgtccattcctcagccattgcctccagctgcacctataacatcattgtcttctgcgacttcagggaccaaccttcctcccttaatgatgcccactcccctagtgccttctgttagcacatcatcattaccaaatggaaccgccagtctcattcagcctttacccattccttattcttcttcaacattgcctcatgggtcatcttatagtctgatgatgggaggatttggaggtgctagtatacagaaagcgcagtctctgattgatttaggatctagtagctcaacttcctcgactgcttcactctcagggaactcacccaagactgggacctcagagtgggcagttcctcagcctacaagattaaaatatcggcaaaaatttaatactcttgacaaaagtatgagtggatatctctcaggttttcaagctagaaatgcccttcttcagtcaaatctttctcaaactcagctggctactatttggactctggctgacgttgatggtgatggacagctaaaagcagaagagtttattcttgcaatgcaccttactgacatggccaaagctggacagccattaccactgactttacctcctgagcttgttcctccatctttcaggtgagtgtgcctggaggtggagaactatggttttgataacttggcagatgtgatttagaagagagttaaatatttgcactgccattgattttagtattcaacaagttatacttgaaaagggtacatattagaagtaggtgtgggccaggcgtggcagcttacgcctgtaatcataacactgggagccaaggtgggaggatcacatgaggccgggagttcaggaccagcgtggacaacatagtgagaccccgtatctacaaaaataaaaataattagccaggtgtggtggtgtgcgcctgtagtcctaggtactctggaagctggggcaggaggatcactggagcatagaagttcaaggctacagtaagttgtgattatgccacagcactctagcctgggcagcagagcaagaccctgcctca

SEQ ID NO: 362815 - DNA, 1214 bp, Homo sapiens
agcggaggggccttgtcggttctgcggggcgagcgccttcgcggaaaactccaaagtaccctctgtggagccttgttgagtatcttcaaaccttcagagggaccttttatcagcgacccatgccgcagtttacagaagaacgctttgtgcgtgctttgggacgtatggatcacttttaaactttttcctttgaagctcagacagcttgcggggggcttgggaggagcgctgcccggggagttagaaggcttgggtcaaagtcatagccctcatacttcttgagagtgaccttgggtgagtcgctggaccctgagccccaaatctccgtctgaaaagtaacccatgccttgtatgcgtcctcgggctgttgcaggagtctttggaaatgatggttctgactctgagttggaaactggaacgcacacaacagatgggaggcgttgaaggaaacagaaaggtcggcctgaggggagaggcgtttcaggaggcttgcggatgtgtgaagtgtgcgcactgtgcttggggcgagcccaagcagtaaccccacccgagtgaagcgttcttggggggatcggctccgggtgggcgacgttccccgcgtgcccccttcccccgagagcactttgtagacactgactccaaaagcgggtctggtctctgcccagccccactttggctggcgtgcttaggtgcctctcgggaagctggagaccaccctcccccattccagcaaacgctccattgaggaacctactgcgtgccaggtcctggggagcttagcgtctgatgaaggatacaacaacaaaagactggaaattcagaagcatgaggggacctcccccctcgagggagaaccagagatggcttcacagagcagacgtttgaactgggccttggaggatggatgagtggaatttggcccagtggagaaagtcatagcagcaggagataagattgtaagggtcaggtggtggggctggataatgcgaatcttgactgtcagacacagacacctgccatctaattagtacgcgagggataaattttggactccgcaggataaggacaaggctacacaatggcttagaacagttaatcgggcaacagttggaaagggcctttgcctcaaaattatgtttgccctgtcttgtgtgaatgcctattcagatgcattatttgaaaaataaataaaccaggcaggcatccagcgtgtt

SEQ ID NO: 362816 - DNA, 1003 bp, Homo sapiens
agcggaggggccttgtcggttctgcggggcgagcgccttcgcggaaaactccaaagtaccctctgtggagccttgttgagtatcttcaaaccttcagagggaccttttatcagcgacccatgccgcagtttacagaagaacgctttgtgcgtgctttgggacgagtctttggaaatgatggttctgactctgagttggaaactggaacgcacacaacagatgggaggcgttgaaggaaacagaaaggtcggcctgaggggagaggcgtttcaggaggcttgcggatgtgtgaagtgtgcgcactgtgcttggggcgagcccaagcagtaaccccacccgagtgaagcgttcttggggggatcggctccgggtgggcgacgttccccgcgtgcccccttcccccgagagcactttgtagacactgactccaaaagcgggtctggtctctgcccagccccactttggctggcgtgcttaggtgcctctcgggaagctggagaccaccctcccccattccagcaaacgctccattgaggaacctactgcgtgccaggtcctggggagcttagcgtctgatgaaggatacaacaacaaaagactggaaattcagaagcatgaggggacctcccccctcgagggagaaccagagatggcttcacagagcagacgtttgaactgggccttggaggatggatgagtggaatttggcccagtggagaaagtcatagcagcaggagataagattgtaagggtcaggtggtggggctggataatgcgaatcttgactgtcagacacagacacctgccatctaattagtacgcgagggataaattttggactccgcaggataaggacaaggctacacaatggcttagaacagttaatcgggcaacagttggaaagggcctttgcctcaaaattatgtttgccctgtcttgtgtgaatgcctattcagatgcattatttgaaaaataaataaaccaggcaggcatccagcgtgtt

SEQ ID NO: 362817 - DNA, 288 bp, Homo sapiens
ggaccacatgctggaaatttggtctctgcagcttaaaatctgagagaagatggtgtctgcagcattcaaagggggaccagagggaccctccacccctggcccccccagctattacaaacatgagccctgggaagattcctatcaaaaacccaagctggggcccatgagtcaagtctggacgtgcagtttggggcaagaggacagatggacgccacaggccatctgtctaaatatttccaaattataaattaaactaacagggtgttaaataaagtatgttctaacctc

SEQ ID NO: 362818 - DNA, 1712 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362819 - DNA, 1298 bp, Homo sapiens
  misc_feature (1221)..(1221): n is a, c, g, or t
  misc_feature (1248)..(1248): n is a, c, g, or t
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgctggggccccgccggggtgcggntaagcgatccttctggggaagcccgcntactccaggttgaacacacggggggggggatgcccggggaaaggttttgg

SEQ ID NO: 362820 - DNA, 1610 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362821 - DNA, 2391 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagatttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtgg

SEQ ID NO: 362822 - DNA, 1548 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362823 - DNA, 1674 bp, Homo sapiens
  misc_feature (1650)..(1650): n is a, c, g, or t
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattataaccantgcgtgttgggtcaaggtctgaaa

SEQ ID NO: 362824 - DNA, 1556 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcatctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362825 - DNA, 1684 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagatttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtgg

SEQ ID NO: 362826 - DNA, 1830 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaaagtctcgttctgtcgaccaggctggagtgtagtggcgtgatctgggctcactgcaacctccacgtcctgagttcaagtgattatcctgcctcagcctcctaagtagccggaattacagtgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362827 - DNA, 1553 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362828 - DNA, 1658 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcatctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362829 - DNA, 1446 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaattggtctcttcccatggcgatgtccatctgccaccgtggcactggtattgctttgagtgcagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362830 - DNA, 1479 bp, Homo sapiens
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcagactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttga

SEQ ID NO: 362831 - DNA, 1355 bp, Homo sapiens
  misc_feature (1289)..(1289): n is a, c, g, or t
acccaaagtatcttttctcttcggggtctcaaccggccaaccaccacgtttttaggccgacctgggaggcagggggaacgcaacagactgcgaagtccttaaggaagaatctaaacaagtccgccgtttgctgtttgggagtgcgatacaaaatgaatatgtacgcaggtggaacgtagactgcagattttgagccagcggcgtttctgccgaaatcctggcaaattccggtagaagtcggctgcaggaggcggaggaggagactaaaaaaccagaaaacaaccagcaaaccagctaggcagagctgagcggagaagctccagagccttttaaagagactctcgtcacatgacacccccaaccccgacccccagccggcgcgcctccgccctcgggtggcggggccgcctggcgtgacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggngttgttaaggctttggtccaatggctgagggttgctggctggaacatcttttcattggtggccccg

SEQ ID NO: 362832 - DNA, 779 bp, Homo sapiens
ctgcaagtttctgttttaaatgataaactaatgaagaaaactgacttgaaactgatgagtgttctttatttgataatggttaagttatgattttggttaaaactgttgagtacattttcctttgcttatactcccattttctttcagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacaggtatgaaccttgctaacaaaggtgacagtgagatagaattgattagtttttgcattaaacaaggaataactagaaaatctggttatgatttttaaaaatttcacaatttctagcctaattttgaaattaaaaaaaaatcaatatgaattagaatctgaaaaccagatttaaagtaaactgcctacttgaattgctatttttaaacactatattttagtacactaaaggtatttgaagggattataaagccacattttggaaattccagtttagtacttgcttagtaaatattttagtcaaattaaaattactataattatttaatgattaataactatttttccattgatgacattttgtgacctttgagataaattttgcctaacttaccatgccctaatgtgagtataaggaaagtgctatcattttataatgaaa

SEQ ID NO: 362833 - DNA, 4233 bp, Homo sapiens
cctaaattcctttatattgccttagtattaaggataatattatcttgcataatcttcctctgaaatatttattacttcccttcttaatgatttggaaaagcagtgtattttagataatatcttcttacagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagggcagtgatcacaaccagattcaacgtatgcacaaagcagcggataccatggtagcggccgtcgctgattgcttttaccatgttggatccattgtcagtctcaaagacctacttccagctaggtgccttgaactcaaatagcttttcacacagacttcaggatgtgagctaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362834 - DNA, 690 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtggtgagtcttccgcacgccgggcgggcgcgaagccggggaaagaagccgtccagccccggggctcggcctcgcgactcggggaagcgagatggcgagagggcagggctgggggttcgggcccagccgtgaagggaggcccggaagctgatggagggggaccttaggacttggctttttcagcggctgcagttgggaggaaagaccggcgagtcaggg

SEQ ID NO: 362835 - DNA, 581 bp, Homo sapiens
  misc_feature (409)..(409): n is a, c, g, or t
  misc_feature (435)..(435): n is a, c, g, or t
gaggatccccgtctgagcacgctgggaagtaggaacattacctgccttctgaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcaggtaaataatccctgtaaatgtgtctgtggatgaataattttgtttgcttattttatcattgtctaatagtaagtttcagttgaaatagttgatggatttatttcctaaaaagtattctggaaatatttagttggtttttggtgcctgtgctataggtgtcatatacaataaatcattggcaaggccnatgtcaagaatatttttccctatgtnttcttctggaagttttacagtttcagatcttacctttaagtcttttatcccttttgagtttatttttgctgtatggtgtaaaatagggttcatgttgccatatggatatccagttttcccagctgctcagacggtaccggctcgat

SEQ ID NO: 362836 - DNA, 749 bp, Homo sapiens
  misc_feature (54)..(54): n is a, c, g, or t
  misc_feature (63)..(63): n is a, c, g, or t
aaactggaaatgccaaattttcagcccagggttttttcaccacccaaactaaanatgacttantacatgggaacttcaatgcaacaagtagaatttgtactacctaaagcttgtatggttggacatgtggacttcaaattcgttttgaactcaaacatcaccaatattccacagatacaagtgacactgctgaaaaataaagctccaggattagggaaagtcaatggtaagaatgtatcaaaatttatctttgaagattttattttgtggttgatttctgaaaactaattttcaccttggctaagtttcgtgtccctttctgtcccttgttgccatttgcctgctttactttttgtgattttatttaaaaaagtaattcagagaacatttcagaacttttcagtaacccagtaatgttcagaattgcataaacttgaatcatataattatacttttttggaagtgagattagttcctttgtaaattagtttgacttttagcattactagctttatgtatttcttttcctaggagaagacttaattgtgaatagaactgttatggaagttacttttaaggttattagtgaagccagcctttcatgtaatgctaaaaatacactcatttttatctttcttacaagttcagaatttgttgcattgagttattaaagtagattatacacatttagcatggttagaaactagatgttactactgagtgttttctccttaataagttagtttaag

SEQ ID NO: 362837 - DNA, 382 bp, Homo sapiens
ttcaatttctacacttagatttcttaaggtgtctcaaattcaacacatcccaaacaagaggagatatatcttggggtggtgcttgggctcagtattccttaacttgcatgctacaagatattttagcaggagaggttcaatttctacacatatgggagaacaaaaagctgatgtatagccctgtatacagtgtagatattatttttgtaaaaacacaaggctaaattaatgaacaagaatactgaatatttcatcattaaaaatttcttgtatttcttgtgcattaatctgacgataatttccctgtatattatgttcatttagctgtttgtaatttttgttaattagatcaggttgtctgcattgttggtgtagaaattga

SEQ ID NO: 362838 - DNA, 238 bp, Homo sapiens
caaagaggcagagatttctatagctaatgacttaattgacttgtgtttttattatatcaacataagatataatttttttatgactgaatttttgtaaatataaaaaatggccattatttcatttggaaactaagttgcattatttcttataacatcatttgttttatgagcgcatgtactttaatttctgatatttctgtgagagctatgtgaattgtcattttataataaaagtgag

SEQ ID NO: 362839 - DNA, 15243 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggaca

SEQ ID NO: 362840 - DNA, 15967 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatggtaaattatgttttaaataggtgttggcttagacatttgaaaatatcttgaaatatactcttactttagaaggccaaatttttaataccaactagatgtatcaagttattttcttttataaaatattacaggacatacattaagaggagaaacttattaatttgctattatggttagtagtttttataggactatagtaatatcaatataaagttagatttttttttttttgccctgctctagaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362841 - DNA, 12210 bp, Homo sapiens
ggcagatcacctttcctttgtctccagctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362842 - DNA, 9110 bp, Homo sapiens
gcggccgcctactactactactgctcgaattcaagcttctaacgatgtacggggacatgtataactgtgttttttgttttctgggtaggaaaggtactttaaaatcacatttaacagaattattaatacaagttttccttcgcctgtaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362843 - DNA, 8031 bp, Homo sapiens
tgtaattcatgatggcgggttgctgaacatgactgtgctggcgtcgatttacagctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362844 - DNA, 2551 bp, Homo sapiens
atacaggaaacattaggtgggcataatggcgtgtgcctgtggtcccggctacctggaaggctgaagtgggagaattacctgagcctgggaagttgaggttgcaattagctgtaattgcaccactgtactccaagcctgggagacagagtaatactctgtttccagatagatggatggatggatggatggatggatggacggatggatagatattttcctatgttagctgaagaaagtgatctgaattatctattgtttcacttcctcttttcataaagatgattatgtttttgctttattgttatgtttatgttattgttatgtttatgaaatagaaattttttattctcagagcggttgtaataagataattgtgaagaagttgacaattttttggaattcacaatttgaactctagaggtgaattctttttagttttattttttaaaatatatacttaaaatgtatatgttatttatcttgaaatattaaataacagaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362845 - DNA, 1333 bp, Homo sapiens
  misc_feature (7)..(7): n is a, c, g, or t
gtcatcngcaacgactctcttaatcctccaccgctacacgtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362846 - DNA, 1347 bp, Homo sapiens
atttagagtgtgacggtacaactgtggtaatgcacgctggcggtacagtttgagtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362847 - DNA, 1359 bp, Homo sapiens
  misc_feature (38)..(39): n is a, c, g, or t
  misc_feature (42)..(42): n is a, c, g, or t
taaaaataaaaaaaaataaaaaaagggagaataaaganngtntttgcaaatagttggatattttagtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362848 - DNA, 1331 bp, Homo sapiens
ccgggcccccccccagcgcttccccaacacctttgcgggtcaaaaccccaactttggtacttgaaaaaatccgataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362849 - DNA, 1212 bp, Homo sapiens
  misc_feature (46)..(46): n is a, c, g, or t
gagttgagctgtaagtaggaatatttgtcatcagtgtcgattcagntctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362850 - DNA, 11842 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgaca

SEQ ID NO: 362851 - DNA, 12198 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcaggcaagtcagatttaagtattagtttttgtttaactttatgtttgatgtatatggaggtttattgtttttataactttattttctgcatccactttgcaaccattgatgactaggaaagttcaagacatctttatagtttgaagcataagaagccagtcaagtggacaaaatgtaaaatacttttaggcacccctaattttttggtttattgtgtcacagtgagaaatgggcagctagaaatacagacaaataattgatggcatgttctcacaataaaccatctggtcattttatactagattaattgcaggatatttggttgaatagcaagattctaattaatacacatttactaaattgaaggtggtgatcagtgatcaagacataaatggagtaggtagaat

SEQ ID NO: 362852 - DNA, 8759 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcaggtatgaattcaggagaaatggtgtatttttacatattattgttagcctggtaaaagatgaaactaattgggaagttcattctaatcctgtcagggatgatttctttattatattcagttggaaaaatattagaaatactttgattaccaaagtaatcacagtttctcaatgatggaccattgataattttaatgattttaagcttcagtactttaattcctactacacatacacacagctgtgattagagattgaatcacagggcatggtggcttgagtttgtagtcctagctactcaggaggctgaggcaggaagattgcttaaggccaggagttcgagaccagcttgggcaacataacactagatcctgtctctaataaagtaaaaaaaattaaccaggtgcagtagcacatgcctacagtcccagctactcgggaggctgaggcgggaggatggcttgagcccaggagttcaagatatagcagaccttgtctcaaataaaaaaaaaaaaatgacttgaatcacctgttttaatttagaagaatctttttatgaggtaatttctaacatttaattcaggtaaattttgtttcttcaagaattttaagatgtgtttgct

SEQ ID NO: 362853 - DNA, 7530 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaaggtatgatctatacttttcaatatagttatctcagaaaagtcaaggagttatgatctttaattacgatcgagaaacttaaatatacattactctgcttaacagagaagccaacctactctggacttttttttggtggggtagtttaactgaaggaaatgtatgataaatgtggtatttaagtattattgtaatgtattaccttcattgtggattgagttccagtaaattgaagataaaggatagtggaatgtatagttttgctaatgtggcattgatagagcagtttatttccattttacaatacaaaattatacaagatgattgcaaatattattgtatcagcctcacaaataaaatgtatatgtaaagtgaaaaatgtggcattctctttacccttagtattgttattggaatattttggtggctgagtttagaattgaaacttctttgggtccagtggtgctcacaaggctcaaatgtagtatgtcttttgtaagtgaaagtgaa

SEQ ID NO: 362854 - DNA, 258 bp, Homo sapiens
caagggttattcacttgcttcacttttggctaaagttgcagcaggcaaggtatgaaactgtcattttgaacaataacaatacagttttaaacattgtggatcagatttaacacactattagaagtagtatgacctttcagtgatgttttactatacgcttggtttgtttgtattttgtctttggagtgacttaaatatatttgggaagaagaatgtttgagttaactttattatttcattttatttattttagagttt

SEQ ID NO: 362855 - DNA, 483 bp, Homo sapiens
gctccttaagaacagtttgagcagaatgttgctatgagttgtttaaactcataaaacaactaaaaaaaaaataaactaaactaaaaaaacgaaatttttttagcattttttggaaatagattcttcatatctattattattattatcatctatcttcatatctattattattcaagaattcaagagtaaaaacagatgtgtaagtattacttatggctctattgtgcctaattttattttgcctttataatgaaatatttcaatgttataatcataaacattgattttattgtgatagaaatttgtggaaacacatattaaagaagagtctttgtggataaagcaggatatcagttaacccacagtaaaaatgtcccatcatagctgttcttttcctttattctttaggtgttggtgtctgtccagtcccttatattagtagctgagccttattttaatgaaccgggatatgaacggtctaga

SEQ ID NO: 362856 - DNA, 457 bp, Homo sapiens
cctttctaaatctatgcaaaggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtatgtttgaattttgaagtaacaaattagtaattgaaaaaagatcagttgtaaacttaggcttttcatttgtttaggtgcacttaaagtttgaaattaatgcctatgatccagcaattgtacaacagcttattctatcaggagacccaagctcaggagttgattcaaggagaccaactttggcgtggctggaggactcctctagttgctcag

SEQ ID NO: 362857 - DNA, 551 bp, Homo sapiens
aaatacaaaaattagccggctgtgttgacgcatgcctataataccagtttttccagtatctgttactgttttcagttgccagttttgtagagtgtgaggatttttagtaaattgtattgaagtagaaatgcctatggtttggaaagtacaacatactgagagtgataacatgtcatttcaggtgttgtgggctgagctttaaaccttatcctaaaatgttactgattcttaatgcgttagttgtatttaatggagaattccttttatttgcatgttttgaagacactggttaaggagcggatttaaagaaatagtgtcttgtttttaaatttattcttttgacttagttcttcataaacattgtttttctgaaaaatattttccctttctcttttctgcatagcatcaataactagctttctcacagtgttagcttggtatcccaatactttgctccggacatggtgccttgtgcttcatagcctaacactcatgacaaacatgcagcttaattgtaagttcataaatttattcatttaaatctctgacat

SEQ ID NO: 362858 - DNA, 865 bp, Homo sapiens
ccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtggtgagtcttccgcacgccgggcgggcgcgaagccggggaaagaagccgtccagccccggggctcggcctcgcgactcggggaagcgagatggcgagagggcagggctgggggttcgggcccagccgtgaagggaggcccggaagctgatggagggggaccttaggacttggctttttcagcggctgcagttgggaggaaagaccggcgagtcagggagtggtgggaggggagttgcctttcgggcctggagcgtccggtctggcttggtcctccgcgagaggtgaggagaccttggagcttggcaccggaggaagcgaggcccgggtaggccctggagaggctgtcggtcctgcgtccggttagatgagagcgaaaggctggaagggttgaccccgggcggagaggctggtggccggaggcgaggggcggggagcgtctgagccggcaaccaagccctcccttgtgggagaggagccggcagtctgctgttctcaggtcccgcagtgcgggggacagaccgcgggctgtgcgcc

SEQ ID NO: 362859 - DNA, 503 bp, Homo sapiens
ctgtttatgaaacacaacatgctgatctttaaaaagttatgttctaccccgaagtgatttgagcgacttatattgatcatacaagtcattttgtattttcagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacaggtgataattaactttgatatttaaatgtttacatatctgtaaagtaacagcagttgaactgtgcgatcttcgtgcttaactctgttttgggaattattttttcttttagtttatgtttatctctcctctcttctctgatggagt

SEQ ID NO: 362860 - DNA, 367 bp, Homo sapiens
tatataatgtcagagtatactttgaactataacagaaatatttgaaatagtttcttctaaaaatatacttgtatcattaatatgatatcttttattttttaggttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggct

SEQ ID NO: 362861 - DNA, 354 bp, Homo sapiens
ttcctgacctcaagtaatccacctgcctcagcctcccaaagtgctgggataacaggcgtgagccactgcgcccggctggaagcttgttttttaaagcaagcagctttattaatccttataatcctatattttaaagagatcatttaaagttaagtctttactttgaatctgatgttgaaaatgtgaatggccaagccaacacttttctttttctttaggtgagtgctccagttgtaacatctaccactcaggaaaagccgaaggatagcgatcagtttgaatgggtgaccattgaacagtcaggggagttagtttatgaagcaccagaaactgttgcggctgaacctccaccta

SEQ ID NO: 362862 - DNA, 508 bp, Homo sapiens
tttctcggtttccagatttaacttagttatatcattttaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaaggtatgtgcataatactactttaaaaattacagactgtcatacaaagaggcagagatttctatagctaatgacttaattgacttgtgtttttattatatcaacataagatataatttttttatgactgaatttttgtaaatataaaaaatggccattatttcatttggaaactaagttgcattatttcttataacatcatttgttttatgagcgcatgtactttaatttctgatatttctgtgagagctatgtgaattgtcattttataataaaagtgagaaactcaacttacaa

SEQ ID NO: 362863 - DNA, 15714 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362864 - DNA, 15724 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362865 - DNA, 12276 bp, Homo sapiens
gtgtatgtgtgtgtgtagttgatgacatttttaccattaaaatgaataatattggggaaaaaacatgccaaatgtttatctcaattagtcaaagataatggttttatgctattcatatcattcctttgttggttgttttttgctgacagcgtgtgaaggtggttcaactttcttctgctcaaacagtataatttgaaagttctggcctactgtactttttgtggagttagttgttgatcttgttctatgaagatgaaaaacagtggaatttattggtgattcagttattttccccattctactccacttctctaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362866 - DNA, 8400 bp, Homo sapiens
tagaggatccgtgcactgtagatcgcagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362867 - DNA, 2545 bp, Homo sapiens
ttacaggcctgaaccagcgtgcccagccgggtcagctgtggaccttggtaagatccaggtaaaagctacattcctgtggacctacttttatattgtacatttgctcattttgtgctttttcttcttctccttatagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362868 - DNA, 1650 bp, Homo sapiens
ggatagcattttgtttttacttctcgttatgacagtttgtttttaagcactcttttttcaattctgtttatgcttttttcgttcgtcaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttttttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagta

SEQ ID NO: 362869 - DNA, 14687 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagccttcacctgtaatctcccgatagttgtctaatacccaacatgtgttgtggaacttattgtttatcagtttactcacctctgctaaatattcccatacttcacctttatcttctgttgttct

SEQ ID NO: 362870 - DNA, 13924 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcagggtacaaaacttttcctattatgccacttttcatttgatgtaaagatgtttcatttacttactgaaacctgcctttgtgtttttgctttatgttaatgattttaaagcaagttcatttacctaaaaattttgttctctgttagattttgttctttatctgatttcaatcatgtatagtctaatttttaaacatttctactatatatgattgctaaatttagtaggctgagaacatacattataaatatttctt

SEQ ID NO: 362871 - DNA, 13535 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcaggtaaataatccctgtaaatgtgtctgtggatgaataattttgtttgcttattttatcattgtctaatagtaagtttcagttgaaatagttgatggatttatttcctaaaaagtattctggaaatatttagttggtttttggtgcccttaatttgatactttgtcatcacttaccatagaacacagaataataaaagtttcattattcctttgtctttatc

SEQ ID NO: 362872 - DNA, 9310 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggtatgtattgagaatattaatcttaccattgtctctgatactataactggtttttttttaagcaatatatggattcattttctttttactttatagtgtaaaactgct

SEQ ID NO: 362873 - DNA, 7396 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcccagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactgtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaaagacagggagaggtttctgacaggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggtatgtaaactataagtgtagacttacagggttggccgggcgcagtggctcatgcctgtaatcccagcactttgggagactgaggtgggtggattatctgagtctaggagttccagactagtgtgggcaatgtggcaaaaccccgtctctacaaaaa

SEQ ID NO: 362874 - DNA, 4198 bp, Homo sapiens
ccgggtcccgcctccctccctgcttctccccctctcccgtcagcctccctccgagtttggcccctccgccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaagagtctcaccctgtcaacaggctggggtgcagttacgcaatcttggctcactgcaacttctgcctcccaggttcaagtgattctccggccttagcctcctgagtagctgggaccacaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatggtaagaatgtatcaaaatttatctttgaagattttattttgtggttgatttctgaaaactaattttcaccttggctaagtttcgtgtccctttctgtcccttgttgccatttgcctgctttactttttgtgattttatttaaaaaagtaattcagagaacatttcagaacttttcagtaacccagtaatgttcagaattgcataaacttgaatcatataattatacttttttggaagtgagattagttcctttgtaaattagtttgacttttagcattactagctttatgtatttcttttcctaggagaagacttaattgtgaatagaactgttatggaagttacttttaaggttattagtgaagccagcctttcatgtaatgctaaaaatacactcatttttatctttcttacaagttcagaatttgttgcattgagttattaaagtagattatacacatttagcatggttagaaactagatgttactactgagtgttttctccttaataagttagtttaag

SEQ ID NO: 362875 - DNA, 777 bp, Homo sapiens
cttggtgcaggcatctggagagggctgcctcccccaggcctcccgcagtgcatgtccgtctgctctggggagggaattggctgatatcccaatctgtctaggggacaccatcacctggggcatcagagttctcatgcccagctggtgctgtgcctggggactagaagggctggtgctgcgtggggtcaagaggtttacctgataaaccggtaagggatgccctcttcccccagtagacttgggaggtgcctcactcccagggtgcctccgtcactctgtcagggatgctgttgtgcaggcttcagtcagcaggctctcatcggggcagcctctcctttgggcagaggctgataggaccaaagaggtttctagaggacttgtggctggaccaagcctctgtcctgtccctggaggaacccaggcctggggtgttgtggtccccagctgagtggagactgtgcctgtgctgagcttgggtagaggaggacaagaactaggccaggcgcggtggctcacacctgtaatcccagcactttgggaagccgaggagggtggatcatgaggtcaggagatcgagaccagtctggccaactttgagaaaccctgtctccattaaaaacacaaaaaaattagctgggcatggtggcacgcccctgtagtcacagctactcaggaggctgaggcaggagaatcacttgaacccaggaggcagaggttgtagtgagccaagatcgtgccacttcactccagccaggtgacagagcgagactctgtctc

SEQ ID NO: 362876 - DNA, 4233 bp, Homo sapiens
attcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacaatataatcacacagggacccagttctttgaaattaggaaaatgagaccgctgagtgggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaacaaaaaacaaaacaaaacaaaaaacatgttatatgcacccccctcccaaagctgattttaagactggctagaattcaaaatataaaaaataaaactatgaagtgatttgaaatcggttttaaaaagttgttagtgcaagagaaattttatgtttaagccatcatggcaatatatgcaaagtttaaatgaatgacagaaatcttgattttagactgtatgttgtgctgttttgagtacactttatttcggaaagtgatatttagtattttctatacactctgaaatcatgagcatttcactttttctaagtcaattatttcataaggattttattaatagatattggtaaatagaactttggaaatcttaattcagaattcttactatacctgagtcttttgtaagctatagttttatgtacaaccttgtacagtttttttgacatacaattcagaactttgtttattctcttggactttgttctggccaatacattttttttaaatctttaagaagaactgtgattgttttagtgggtatttttctaattaaatgaaaacttgtataatggtattttagagaatgccagtaagtgcatgtttcaagttaatgtttttctcatcacttgtatgtttctaacacagcatgggactttaataaaaccatcctggaaacttaaagatt

SEQ ID NO: 362877 - DNA, 434 bp, Homo sapiens
atataatcacacagggacccagttctttgaaattaggaaaatgagaccgctgagtgggtaagtggtgcatgatctatgggccagatgacctctctcctacattcgagctgccagcttcctctcccaacctctattcccgtagcccatggctcaggtatcctagtctgtaaggggtggaggcggagggtgccccagggccaggttggaggtgggactgaggactgagcaactctgacagtggagctcagtggtgaattctagcttccagggtggaggaggcttgtaaactctgcctctcgaggcttcatttatttgttctattgtaatgcccccgtgctggggcattgggagggtgctatggagtactggcactaactccaggaattaactcttgtgctttggtgccttcctgcaaggtgacttctcccttttcc

SEQ ID NO: 362878 - DNA, 4282 bp, Homo sapiens
attcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggcaccgccggtaagcagggagcctccgcggagctcccgccgccgctcccccttggcgccaaaggcacccggtcccggagcagccacgcgcggcccgtgagcctcgccaccagcgggggctcagaggaggaggacaaagacggcggggtgctgttccacgtcaacaagagcggcttccccatcgacagccacacctgggagcgcatgtggatgcacgtggccaaggtgcaccctaaggggggagaaatggtgggcgccatcaggaacgccgccttcttggcaaagccttcaataccccaggtcccaaactacaggctgtcgatgacgatcccagactggctccaggcgatccagaattacatgaagaccctacagtatccttccaaccaaggtctgagcacacccagccaggggacaggcatggtgatcgcaagcctggtggcaaatctgtccccagctggtcatcaaaagctctctaaggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaacaaaaaacaaaacaaaacaaaaaacatgttatatgcacccccctcccaaagctgattttaagactggctagaattcaaaatataaaaaataaaactatgaagtgatttgaaatcggttttaaaaagttgttagtgcaagagaaattttatgtttaagccatcatggcaatatatgcaaagtttaaatgaatgacagaaatcttgattttagactgtatgttgtgctgttttgagtacactttatttcggaaagtgatatttagtattttctatacactctgaaatcatgagcatttcactttttctaagtcaattatttcataaggattttattaatagatattggtaaatagaactttggaaatcttaattcagaattcttactatacctgagtcttttgtaagctatagttttatgtacaaccttgtacagtttttttgacatacaattcagaactttgtttattctcttggactttgttctggccaatacattttttttaaatctttaagaagaactgtgattgttttagtgggtatttttctaattaaatgaaaacttgtataatggtattttagagaatgccagtaagtgcatgtttcaagttaatgtttttctcatcacttgtatgtttctaacacagcatgggactttaataaaaccatcctggaaacttaaagatt

SEQ ID NO: 362879 - DNA, 3998 bp, Homo sapiens
attcgagaatgggacatggaatgaggcgacggccccagcaagccccagcagccccagccccagccccaggcccagcagcagcagcagcagcccctgctctcccgccgcccggagaggctctgcagccatgaagccaaccgtcccgagccttcaataccccaggtcccaaactacaggctgtcgatgacgatcccagactggctccaggcgatccagaattacatgaagaccctacagtatccttccaaccaaggtctgagcacacccagccaggggacaggcatggtgatcgcaagcctggtggcaaatctgtccccagctggtcatcaaaagctctctaaggttaatggaaacagcaaaagaaatgacccgagagtccttgcctatcaaatgccttgaagctgtcatcctgggcatctacttaaccaatgggcagccttccattgagcggttccccatcagctttaaaacctacttctcaggaaactactttcaccacgttgtgctggggatttactgcaatggccgctatggctcattgggcatgagccgcagggctgagctgatggacaagccattgacttttcggactctgagtgacctcatctttgactttgaggactcttacaagaaatacctgcacacagtcaagaaggtcaagattgggctgtacgtcccccatgagcctcatagcttccagcccattgagtggaagcagctggtcctcaacgtctcaaagatgctgagggctgacataaggaaggagctggagaaatatgccagggacatgagaatgaagatcctgaaacctgcaagtgcccactctccgacccaagtgagaagccggggaaaatccctgtcccccagaaggagacaggcaagccccccgaggaggctcggccggcgagagaagtcgcctgcactgcctgaaaagaaggtggctgatctgagcactctgaatgaagtgggctatcaaatccgaatttagccaagccataccggccagcaagagggtttctgtggtgcttctctctgcactttacccagcatcttcaggaggaactgcaactatttattaagaacttgtgaattttatttttaaggattcacctggaaatagaatctgagtgggtggtaaccattagctttaaaaaattcactaaaaggcaccatgaaaaggctgaagtaataagccccactggggttggactatgtccctcactcaagatcttaaggataaccgtaactgaagttttatatttttccatttacctactttcttttacttgctttgaacattatgcctcaccaatagtaaatgttcatgaaataatctcttgaacttttggtatagtaaggtaactctaacagtattactgtctttttcagcaataacagaaagcaaaaatgggtgggttttttttaagcagttattacctcagcattttgacatcagatatgcaaacttaatggcgttttgtttttttatattctatttgtattctttccccagtatttcccatggggatctccacaagtttggagttttttcctggtgcacacacgtgaggagatttaaggtactatatgcaagtgttttactaaaaagcactgaaattcttctggcaatacaagaaccattttcaggatcttggagttacttccttcttaatctttcttaaagcattcactgatgtttttgttttttcaaaatgaaacaaaaatatcacattgagaagctagtctatgttctgtcactaacatttaaactttgcagactctaacaaaaagcacaagaggtcacgtactattatacaaatttagcggtactggatttacctctgacattaacacactcaggcagagaccaggagtgatcagcaggtcttcagaaccaaaaaacctttctgttcacatttcatctgatttttaaactgaggcaggctttgattcttctgaaggatgccaagaatcaaactaagggaggactcactgttaaagatgtgttctgatgtcttatattaagaccaaatgtgacatgatgtgattatcttccagtactttgcttttaggtaccatttcatgacattttaggaatgagtattggaaaatataaagaattagaaaagcagcactttttttttaatggaaaagtcttcggtccagtgttacaccttatagtgtaattcagtccctaagcacagaatgaatgtctggcctgcatatggtagttacagtgtaacctctggctgcagaccacacaggacaaccctaacagcctagtcttgtatggtgtaaatatcaagagtacagcttcaatttcatttgctttatcttagcaacaatgccaactcaggagagcagacggccgatttcagtgaagtctggtagtcaacagatgttatttcagtctcagtgcatctcctctggctttctttgactgaaggtgtttataggaaggaagttaaaaaaaaaaaaagctcattgagattctttaccaattctttacaagatttctgggggtgacagggaaagcaaaaggacttcaaagcaaaagggtgcacaagagcttacttcaccctgaaaatcagtattattaatgaaaagtactgttttcttaaagaagtcgaatgtcctttagatgaacaagaccaagtatacatctccattagattaaaatgtagcacagggttaaaaattatcagtttaatctctttaagaacagtattatcagagtttaaaatgagttagctctgtttatctacacacagcaaacccattcgcagcctcttggccacatgtattcagatgtttgaaatagtgaatcatttcattttcattctaaaacaatactgacttagccatataccttctgtttgtcaatctgaaacttgcttacatctaataagtagacctcttataacactgcaaccattctaagagttggaatttatttttgccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttgatttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaacaaaaaacaaaacaaaacaaaaaacatgttatatgcacccccctcccaaagctgattttaagactggctagaattcaaaatataaaaaataaaactatgaagtgatttgaaatcggttttaaaaagttgttagtgcaagagaaattttatgtttaagccatcatggcaatatatgcaaagtttaaatgaatgacagaaatcttgattttagactgtatgttgtgctgttttgagtacactttatttcggaaagtgatatttagtattttctatacactctgaaatcatgagcatttcactttttctaagtcaattatttcataaggattttattaatagatattggtaaatagaactttggaaatcttaattcagaattcttactatacctgagtcttttgtaagctatagttttatgtacaaccttgtacagtttttttgacatacaattcagaactttgtttattctcttggactttgttctggccaatacattttttttaaatctttaagaagaactgtgattgttttagtgggtatttttctaattaaatgaaaacttgtataatggtattttagagaatgccagtaagtgcatgtttcaagttaatgtttttctcatcacttgtatgtttctaacacagcatgggactttaataaaaccatcctggaaacttaaagatt

SEQ ID NO: 362880 - DNA, 879 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattgga

SEQ ID NO: 362881 - DNA, 671 bp, Homo sapiens
  misc_feature (29)..(29): n is a, c, g, or t
  misc_feature (35)..(35): n is a, c, g, or t
  misc_feature (41)..(41): n is a, c, g, or t
ggcccggtggcgccctgacccggggcccngaaaangcaaangtatattgggaccgggcctaggctggagtgcagtggtgcaaccacagctcactgcaccttcaaatgctggagctcaagcaatcctcttacctccgcttcccaagcagctgggaccacagatgtatcctccactcctcgctggccaccatcctgctgcccaacagaagaagctcttctgtctccgatttcctgaacggtctaagggagccagtgggctaggcccatgctttggttcaaagcgtttggagaacatcttcttgctccttttccggaaacgagataatggacacagagtcccagacgtcatcctttggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 362882 - DNA, 658 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaataaa

SEQ ID NO: 362883 - DNA, 3276 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacgggtctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtacacccaattaaagatgcagttatgtttataaaataagaagaaatagacttgttggctgtttttttctatttctgactctgccatgaattttttttttttttttaaagacaatatctcactctgttgcctaggctggagtgcagtggtgcaaccacagctcactgcaccttcaaatgctggagctcaagcaatcctcttacctccgcttcccaagcagctgggaccacagatggagttttgctcttgtcacccaggctggagtgtagtggtgcaatctcagctcactgcaacctctgtctcccaggttcaaatggttctcgtgcctcagcctcccgagtagctggggttacagatgtatcctccactcctcgctggccaccatcctgctgcccaacagaagaagctcttctgtctccgatttcctgaacggtctaagggagccagtgggctaggcccatgctttggttcaaagcgtttggagaacatcttcttgctccttttccggaaacgagataatggacacagagtcccagacgtcatcctttggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 362884 - DNA, 3166 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacgggtctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtacacccaattaaagatgcagttatgtttataaaataagaagaaatagacttgttggctgtttttttctatttctgactctgccatgaattttttttttttttttaaagacaatatctcactctgttgcctaggctggagtgcagtggtgcaaccacagctcactgcaccttcaaatgctggagctcaagcaatcctcttacctccgcttcccaagcagctgggaccacagatggagttttgctcttgtcacccaggctggagtgtagtggtgcaatctcagctcactgcaacctctgtctcccaggttcaaatggttctcgtgcctcagcctcccgagtagctggggttacagatgtatcctccactcctcgctggccaccatcctgctgcccaacagaagaagctcttctgtctccgatttcctgaacggtctaaggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 362885 - DNA, 3153 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacgggtctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtacacccaattaaagatgcagttatgtttataaaataagaagaaatagacttgttggctgtttttttctatttctgactctgccatgaattttttttttttttttaaagacaatatctcactctgttgcctaggctggagtgcagtggtgcaaccacagctcactgcaccttcaaatgctggagctcaagcaatcctcttacctccgcttcccaagcagctgggaccacagatgtatcctccactcctcgctggccaccatcctgctgcccaacagaagaagctcttctgtctccgatttcctgaacggtctaagggagccagtgggctaggcccatgctttggttcaaagcgtttggagaacatcttcttgctccttttccggaaacgagataatggacacagagtcccagacgtcatcctttggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 362886 - DNA, 2322 bp, Homo sapiens
agtggtagtgtccacgggtctaatgtaagcccatttggcatcactcctctcctctctcgagaggatttcttgtgcacagagtatgaagcagttgtggagcgctgtgcctttgtcaagataccatcttgtttgatgatttctttctttgctgttttttcttcaaaatgctggagtgcagtggtgcaaccacagctcactgcaccttcaaatgctggagctcaagcaatcctcttacctccgctttccaagcagctgggaccacagatggagttttgctctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacgggtctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtacacccaattaaagatgcagttatgtttataaaataagaagaaatagacttgttggctgtttttttctatttctgactctgccatgaattttttttttttttttaaagacaatatctcactctgttgcctaggctggagtgcagtggtgcaaccacagctcactgcaccttcaaatgctggagctcaagcaatcctcttacctccgcttcccaagcagctgggaccacagatggagttttgctcttgtcacccaggctggagtgtagtggtgcaatctcagctcactgcaacctctgtctcccaggttcaaatggttctcgtgcctcagcctcccgagtagctggggttacagatgtatcctccactcctcgctggccaccatcctgctgcccaacagaagaagctcttctgtctccgatttcctgaacggtctaagggagccagtgggctaggcccatgctttggttcaaagcgtttggagaacatcttcttgctccttttccggaaacgagataatggacacagagtcccagacgtcatcctttggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 362887 - DNA, 788 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtaaagatactttgagctgttaatgggtgttgacaaaacagaaatttgtcaccagaaaaaaagcctctcttgtgagtctttattcaagactggtaatgattatatagaatattttttatttgctttaaaacaaagttttagtgttattcaaatccttaagaaagtaagttattgctagaagttactgtttttgtcatgttacactgcccatgatatagataaaaaatgttgctattcaaatggatcttggactccagtgctaatgatggatttattattatcccaattgttgaccaataatgttacttacaagatggctgacta

SEQ ID NO: 362888 - DNA, 569 bp, Homo sapiens
atcttagtgcataagggtgcatgtgcacaatgtgcaggtagttacatatgtatacatgtgccatgcctaggctggagtgcagtggtgcaaccacagctcactgcaccttcaaatgctggagctcaagcaatcctcttacctccgcttcccaagcagctgggaccacagatgtatcctccactcctcgctggccaccatcctgctgcccaacagaagaagctcttctgtctccgatttcctgaacggtctaaggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 362889 - DNA, 591 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaatgttggccataggaggcaaaggagcaagttactg

SEQ ID NO: 362890 - DNA, 2337 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacgggtctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatac

SEQ ID NO: 362891 - DNA, 3043 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacgggtctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtacacccaattaaagatgcagttatgtttataaaataagaagaaatagacttgttggctgtttttttctatttctgactctgccatgaattttttttttttttttaaagacaatatctcactctgttgcctaggctggagtgcagtggtgcaaccacagctcactgcaccttcaaatgctggagctcaagcaatcctcttacctccgcttcccaagcagctgggaccacagatgtatcctccactcctcgctggccaccatcctgctgcccaacagaagaagctcttctgtctccgatttcctgaacggtctaaggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacgtcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctca

SEQ ID NO: 362892 - DNA, 821 bp, Homo sapiens
accggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaacactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattgga

SEQ ID NO: 362893 - DNA, 474 bp, Homo sapiens
gctggagtgcagtggcgcgatctcggctcaccgcaacctctgcctcccgggttcaagtgattttcctgactcagcctcccaagtagctgggattacaggcgcgtgccaccatgcccagctaattttttatatttttagtagatatggggtttcaccgtgttagccaggatggtcttgatctcctgaccttgtgatctgcccgccctggcctcccaaagtgctgggattacaggcatgagccaccgcaccaggcatgtggacctttcaatagtcaagttttgtttttcatgcacacttagaaagtaagcaggaaaatatgtttaattggcactgttctgccagatggatataatggctagaccatagaatctaagagaagtaaagataaaagttattatgtgggtgacaaaataatctgtacaccaaaccctcatgacatgcaatttacctatatagcaaacctaaacatgtata

SEQ ID NO: 362894 - DNA, 3292 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362895 - DNA, 3008 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagcccgcggcccgagccgccgccgcccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362896 - DNA, 2938 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaatctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362897 - DNA, 2894 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaatccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362898 - DNA, 2926 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaacagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362899 - DNA, 1857 bp, Homo sapiens
tgactcttttgctggagtgcctcaaaggcttccgagtgtctgaagcctccgtcctccttcggcccgtgggaatcggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362900 - DNA, 3314 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccctcgtgccgaattcggcacgaggagagaactagtctcgagtttttttttttttttccttttaaatgaagaaaagctttgcttaagggttgcatacttttattggagtaaatctgaatgatcctactcctttggagtaaaactagtgcttaccagtttccaattgtatttagcttttggttggaatttgaaaaaaaaagaaacaaagaaaaagaaaacctaaataaaataggtgaaagttccctgactattcaggtgaatacacaaaaaatattaattatatattattattaattaattttatttatatattatattattctattctattatctatactttttatttttttttatttttctcttttctcttatactctttaaatataaaatatatcttctggtggggcctctcttccacatttccctttttggggcggtttcaaattatatgtgcccctttttaacaaactttgtctggg

SEQ ID NO: 362901 - DNA, 2861 bp, Homo sapiens
  misc_feature (2847)..(2847): n is a, c, g, or t
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccgggctagtcggnaggatcctctagag

SEQ ID NO: 362902 - DNA, 1736 bp, Homo sapiens
  misc_feature (3)..(3): n is a, c, g, or t
tanaagaagtcaaggaacacctatctaaacagtagtggtgagtccactctatcaagccaacccaaaatggtgccactctcattatatggaacttctgctttttgccaactaatcagaaataggaaagtgcacaccagtatgcacaatgacctaattgctcatatggaattcaaacagcagtcatgctgtcccccactgtaaaagatctagttctccaattaatcacaatctgttacgatgagtgaggaggtttgaggtgttggggatacccaacaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362903 - DNA, 2859 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaacgcaatcgagaggagaggcgatctccagaggaaacgggcggtatccatgggggcatgccgggactaagatcctagtatctgtcgagcactgaagtacaattgttgacgacaggccatagggtatgaggccctgttgggcctaggtgaggtgactaactgtcgtatgatgtaattgatctgaaaggagatcctcctgccctgtccggaattcctcggtatcgttatctacctc

SEQ ID NO: 362904 - DNA, 1128 bp, Homo sapiens
tctctctctctgtctctctctctctctctctctaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362905 - DNA, 2987 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362906 - DNA, 2833 bp, Homo sapiens
gggccgcgggccggcgtgcgtggcaagctctcccggctcggctcgctcggcctcccttaccgggaggcggggtcggcgccgcggcggcggaggcaggccccctcctcccgcctcctcggcccggcctccttccccggccgcgcgtcctctcgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362907 - DNA, 2852 bp, Homo sapiens
tgctggtctgttttgttttaatacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362908 - DNA, 1956 bp, Homo sapiens
tacccacgcacacgcaattcatttagaccttttcgtgaatcttctccactttcacaaacaacctatccagatggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362909 - DNA, 2299 bp, Homo sapiens
gggccgcgggccggcgtgcgtggcaagctctcccggctcggctcgctcggcctcccttaccgggaggcggggtcggcgccgcggcggcggaggcaggccccctcctcccgcctcctcggcccggcctccttccccggccgcgcgtcctctcgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaatccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362910 - DNA, 2942 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgaatgttgtgctggagaattacccacttctttgtaatagtattcgaggaaagtgccacacgctagaggaggtctggtcttgttggattgaactgcttcactactcttggatcttgaactacctggttacgctctt

SEQ ID NO: 362911 - DNA, 2933 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccgggtgccctctgtccccactgccggcccatgttctctctccggaggtcaccaaggaatgcacaggtttcgactaccagaaaggggagtccttgggttctttcaacaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 362912 - DNA, 2543 bp, Homo sapiens
gtgagctccgtcagccgctcctccaccgtgttctccagggacgtgaagtcccgctcccgggcgtccttcaccacatggatcccagcccgcggcccgagccgccgccgcgcccgccatgccctcggccaaacaaaggggctccaagggcggccacggcgccgcgagcccctcggagaagggtgcccacccgtcggccgcgcgtcctctcgccgctccgacgccagcagcgcccgcgtgccgctcgcccagtcccgggggagcccctgcaagtttcccgggccgcgcgccgcgctcgctcgcctcccagccccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcaccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttactttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcaaagaccccaaaaggggaaccgagctcga

SEQ ID NO: 362913 - DNA, 164 bp, Homo sapiens
agccaaacacctgggtgttcagccaggtcccccaggcagcagcgtggaggaacctttggcaggtccagccagcctcatgtccctatctatctctgccacctctgctcctctgtcgttctatagaaccagatctcttcccactcactttctcttgggcaaacctt

SEQ ID NO: 362914 - DNA, 411 bp, Homo sapiens
gacttcagaagtaaaattatataatcatattgaaacaggcaaataaaacacaattcgttaaaattttttttttttccaatgagatcacatggacatagggaggggaacaacacacactggggcttgtcagggaatgggaggcaaggggagggagagcattaggacaaatacctaatgcatgcggggcttaaaacctagatgatgggttgataggtacagcaaaccaccatgacaaaccaccacatgacatgtataacctatgtaacaaacctgcacattctgcacatgtatcagaacttaagtaaaataaataaatatatattaaaaatttctcttttttttttttttttttgagatggagtctcactctgtcgcccaggttggagtgcaatctcagctcactacaatgtc

SEQ ID NO: 362915 - DNA, 518 bp, Homo sapiens
agctcgtaccatccttcctcattacgatcctccctctctcacgatatcacttgcgtccacctctcagcagttttcccaactgcgcggttgctgagcagcgctaggggaaaggagggtgacagaggtggggtgatgaggactgctggacccgcaaggttctggcgatgcagggccatcctcccatcctccctctgatttccaggttgtgaattgctgcaggatatcatgaactacattgtacccattcttgtgctgcccagggttaacggtaaggaactttgaagaaaccattcattttcagtcatgggggaagagggtggggttgattacccacagccacctgttacctggccccaggtatgagggctgggcagtggtgatgtcaagtgaacttcaaatggcatctgacccagaaatgaatgcaacaaaaaggaactcacatgagttgacttactacacatgggttgattcattattgcgtgagtttgtccttacaaaacccccgtgagatgaaggat

SEQ ID NO: 362916 - DNA, 984 bp, Homo sapiens
caacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtggctgatccaactcttccacaaaaaaattgagtctgcgcttcgaaacaagatgaacagccaggtaggaggggctcagagccccatcagcaaacagaggagaagggcccttagtaaccacacacctcccccttctacggacactctgctgtcactccagaccccttggtagtccttatggccctttgaaaccacaaccccagctctaaaatccagtcatgtatgttttgctgaagagtccaccaagagaccaagagacaatcacttcccacactcccagcaaactttccctcatgccaagcttgggccacctctgcttttccccagccttcctccctgctgagaaaatgccattctctttctgcctccctctcttcccatagccctgctagcctccct

SEQ ID NO: 362917 - DNA, 371 bp, Homo sapiens
gggattacaggcgtgagccactgcgcccggcctatttccccacctttcgtgtaaggtgctactgaacatgacagcttcttgtcatgacaggaaactcagcatcatgtgtatatccatttagagactctgaatatttgcaaagagacaaatttgcccactctgaacactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgaaaactgtgt

SEQ ID NO: 362918 - DNA, 516 bp, Homo sapiens
gcatccacctcctctcaaaaccctcccagcatctgtgaggtcactaggattctctctgttctacaaatgacaaaaagtgctcagagaagtgcaaggacttgtccaaggtcatccagagtttggttcaagcctaggtctctctgtgcccttgaccctgtgtcttagcgactcatctcagggctgttggaagaagagacttccagcgatgctgccgtgggagccagctcatggtccattttctttctctctagtaatgaccaaaatagattctgtggctggaatcaactatggtctggtggcacctccagcaaccacggctgagaccctggatgtacagatgaagttatttgtttgcttcaaaacacattcaatgtgaaaaagaaactttagaaactgcagaggaatgcagaaataaatataggaaagaaggaaaaaaaagagagagagagagagaattacccgagtctacaacctagagataagcatcatcaataaataagtgtagatccctccaac

SEQ ID NO: 362919 - DNA, 2041 bp, Homo sapiens
tggctcaagaagagggcctaagtggaagggacagggagccaggaagaaagcccagagaagctcccacatcttcagtgaaggaggaagagcttgcaaagaagtctggggaaaagcctgtaggggataggaagaaagcggaaggccttggtcacaggactctagaaggagtgtttctagaagggaatgggcaaccacaccaggagctacccagtagtcaagaaatgcaaggactgaagagactgctggattactgagggaaaggtcattcgagagcaacatcaggagagggagggaaggagcttgtctgaccaccagccccagccccaatctcttagtgaggagaagcctgtggtttaaatcctatattctagctatctattgcttgaaaacaaacaactcaaaatttggtatcataaaacaaccaccattgttaacattcatggattctgtgcatcaggaaaaaggcatgacagggatggctaagctctctgctccatgaggtctgaggcctcacctcagaagactcaaaagttccatgttagaattacctggagagttcctctctcccatctctggtgcctgggctaggaagacttgaaggctcagctctgctgggactattgacccaagccacttccatggtctctccacagggcttgggcttctcgtagcattgagtgggttctgcacagccttttatgacctcacctctgaagttacacaaaggtcaggtgtattgttgtgttctgttgcttagaagcaagtcggcaagcccagattctagtggcaagttcacagactccatctcttggtgggggtgtggcaaagccacattacagaagagcaaatggaatggaaaatgtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggtgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgaaaactgtgt

SEQ ID NO: 362920 - DNA, 1640 bp, Homo sapiens
caacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtggctgatccaactcttccacaaaaaaattgagtctgcgcttcgaaacaagatgaacagccaggtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggtgagtctgaggcccttggtggcttcttcctccttctgacctggcggcggggagggggacatgtcataggctcgaggcattatttaagaggctactggctcatttgcatttaatttggttgtgaattaatagttcaaggagcttcgtgggcagagggacctgagccagaatccctgctccatacttactaactgtgaggccttgggcaagtcacttcccttttctgaactccagaccttccccacctgagtgagtgtagtatggtttaaatgggattaaacatgcacaactctgtctcaggaatcactagtgaattcgc

SEQ ID NO: 362921 - DNA, 1930 bp, Homo sapiens
tggctcaagaagagggcctaagtggaagggacagggagccaggaagaaagcccagagaagctcccacatcttcagtgaaggaggaagagcttgcaaagaagtctggggaaaagcctgtaggggataggaagaaagcggaaggccttggtcacaggactctagaaggagtgtttctagaagggaatgggcaaccacaccaggagctacccagtagtcaagaaatgcaaggactgaagagactgctggattactgagggaaaggtcattcgagagcaacatcaggagagggagggaaggagcttgtctgaccaccagccccagccccaatctcttagtgaggagaagcctgtggtttaaatcctatattctagctatctattgcttgaaaacaaacaactcaaaatttggtatcataaaacaaccaccattgttaacattcatggattctgtgcatcaggaaaaaggcatgacagggatggctaagctctctgctccatgaggtctgaggcctcacctcagaagactcaaaagttccatgttagaattacctggagagttcctctctcccatctctggtgcctgggctaggaagacttgaaggctcagctctgctgggactattgacccaagccacttccatggtctctccacagggcttgggcttctcgtagcattgagtgggttctgcacagccttttatgacctcacctctgaagttacacaaaggtcaggtgtattgttgtgttctgttgcttagaagcaagtcggcaagcccagattctagtggcaagttcacagactccatctcttggtgggggtgtggcaaagccacattacagaagagcaaatggaatggaaaatgtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatggtgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgaaaactgtgt

SEQ ID NO: 362922 - DNA, 1019 bp, Homo sapiens
caacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtggctgatccaactcttccacaaaaaaattgagtctgcgcttcgaaacaagatgaacagccaggtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggcgtcccggttcaagcgtcccagttggt

SEQ ID NO: 362923 - DNA, 1212 bp, Homo sapiens
tggctcaagaagagggcctaagtggaagggacagggagccaggaagaaagcccagagaagctcccacatcttcagtgaaggaggaagagcttgcaaagaagtctggggaaaagcctgtaggggataggaagaaagcggaaggccttggtcacaggactctagaaggagtgtttctagaagggaatgggcaaccacaccaggagctacccagtagtcaagaaatgcaaggactgaagagactgctggattactgagggaaaggtcattcgagagcaacatcaggagagggagggaaggagcttgtctgaccaccagccccagccccaatctcttagtgaggagaagcctgtggtttaaatcctatattctagctatctattgcttgaaaacaaacaactcaaaatttggtatcataaaacaaccaccattgttaacattcatggattctgtgcatcaggaaaaaggcatgacagggatggctaagctctctgctccatgaggtctgaggcctcacctcagaagactcaaaagttccatgttagaattacctggagagttcctctctcccatctctggtgcctgggctaggaagacttgaaggctcagctctgctgggactattgacccaagccacttccatggtctctccacagggcttgggcttctcgtagcattgagtgggttctgcacagccttttatgacctcacctctgaagttacacaaaggtcaggtgtattgttgtgttctgttgcttagaagcaagtcggcaagcccagattctagtggcaagttcacagactccatctcttggtgggggtgtggcaaagccacattacagaagagcaaatggaatggaaaatgtaatttgccatgttccgttttacagatgaagaaatagaggtctagataaatggaacaacttcctcagtgtcaaagtcagtgtgtggcccaagtcagattttctcaggctagtgtttgttccattgtgagtcatgggctaggggacagggggattggggtggagtggcaaaggcaggtagggaatggcttctctggccatacataccaaacatgagggtgcccacctagacttaagcagaaacactgcccatgctcccagaagcccaggtaagggaaggctggccattgactacctcgtatttgtttattacctcattccacaaaggatctgagacagcaaaatcaaacag

SEQ ID NO: 362924 - DNA, 419 bp, Homo sapiens
tgcagaatttgtgggtcagtgctctgttgtcacataggggctggccactgtctgtgtgtgcagtcagcctctcaccccgatacagaactcaccccctctgctccgtctgtaacagcatcctccgagatccttttctcatctcttgctacagattccaaaggagtccaaatttcgactgacaaccaagttctttggaaccttcctacctgaggtatggaagaccttgctttcctttagtgagccccgggggttctgggaggacagggctttgctgagtggatgatgagagccctccacccaacataacacacacaagatccagaaacaacccagcatgaaagggtggaaatagcttcatccacagaacagagaaaagctccaagcgcccagttgaccaggtgtgggagtagatgctggca

SEQ ID NO: 362925 - DNA, 422 bp, Homo sapiens
tccagcttcccagttcccagataagcatggtgcccaatgtgggccttaagttctccatcagcaacgccaatatcaagatcagcgggaaatggaaggcacaaaagagattcttgtgcgtttccatgcttgcggtttgttgggtgtgctcttggtgatatttggacgggattagagagtcagcgtctctggaatgcccaatttttgccttgcctattaccacctatagccacagcgttcctcaggaaattcttcacatgagaagattcaacataacccttgattaatagctgagaatttatccacatctcagtgcaggatactggcgaggctgagttggtgtatgtggcttagggtggaaatctaagtggaacctttaatttatcccgtttatcagttagctattgctgtgtaacaaaccatcc

SEQ ID NO: 362926 - DNA, 391 bp, Homo sapiens
ggagggggacatgtcataggctcgaggcattatttaagaggctactggctcatttgcatttaatttggttgtgaattaatagttcaaggagcttcgtgggcagagggacctgagccagaatccctgctccatacttactaactgtgaggccttgggcaagtcacttcccttttctgaactccagaccttccccacctgagtgagtgtagtatggtttaaatgggattaaacatgcacaactctggtagagaaaatctgctcaacaaatgtttgttggatgaacaaatgaattactttattgagcacctattatgtgccaagtactcttccaagtatggggtaggctgatgcatcagacagggaagtgatgccttctcagagccttacatgg

SEQ ID NO: 362927 - DNA, 416 bp, Homo sapiens
atgctgccctgctgagccgttgtgaagctgacccttcttggtttggaggccttgcaatcaggtgcctgggtcagggcacttcaccctgggttgttgttttggcagcacacaactggttccatggaggtcagcgccgagtccaacaggcttgttggagagctcaagctggataggtaagtgggcctgtgagaggaggagggggctgcccctctgtccttggtgtctgtgggatgacagtggtcctgtgatatacagaagcactgcattgttgttttcctgttggctcatcacattaaaacctcaaagagtgtgcgatggccacagtatccccattttgcagaccatgaaactcatgctcagagaaaaagtgacttgctcgaggtcacacattgtaggtgaccaaccatctcagctta

SEQ ID NO: 362928 - DNA, 1829 bp, Homo sapiens
caacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtggctgatccaactcttccacaaaaaaattgagtctgcgcttcgaaacaagatgaacagccaggtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggtgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgaaaactgtgt

SEQ ID NO: 362929 - DNA, 1989 bp, Homo sapiens
tggctcaagaagagggcctaagtggaagggacagggagccaggaagaaagcccagagaagctcccacatcttcagtgaaggaggaagagcttgcaaagaagtctggggaaaagcctgtaggggataggaagaaagcggaaggccttggtcacaggactctagaaggagtgtttctagaagggaatgggcaaccacaccaggagctacccagtagtcaagaaatgcaaggactgaagagactgctggattactgagggaaaggtcattcgagagcaacatcaggagagggagggaaggagcttgtctgaccaccagccccagccccaatctcttagtgaggagaagcctgtggtttaaatcctatattctagctatctattgcttgaaaacaaacaactcaaaatttggtatcataaaacaaccaccattgttaacattcatggattctgtgcatcaggaaaaaggcatgacagggatggctaagctctctgctccatgaggtctgaggcctcacctcagaagactcaaaagttccatgttagaattacctggagagttcctctctcccatctctggtgcctgggctaggaagacttgaaggctcagctctgctgggactattgacccaagccacttccatggtctctccacagggcttgggcttctcgtagcattgagtgggttctgcacagccttttatgacctcacctctgaagttacacaaaggtcaggtgtattgttgtgttctgttgcttagaagcaagtcggcaagcccagattctagtggcaagttcacagactccatctcttggtgggggtgtggcaaagccacattacagaagagcaaatggaatggaaaatgtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggtgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgaaaactgtgt

SEQ ID NO: 362930 - DNA, 1537 bp, Homo sapiens
caacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtggctgatccaactcttccacaaaaaaattgagtctgcgcttcgaaacaagatgaacagccaggtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatggtaagcagttcctgggttggacagatgaggagccccagacagtcccaacagcactgtctttggagtcaggagaccatgtgaatcctgtctggattcaaacctggactgtgtcactccggagcctgaggcttgagtcactgtactcaatggtgccgactcctggaggtattcattcacccagccattcactagtgcgtttgtttacttattcattcaattattcattcagtcaatttctcattcattcaattattcattccatgttggcttgaaatatgtgtactgttccaattcatccatttatatctttagtcattcaattatgca

SEQ ID NO: 362931 - DNA, 665 bp, Homo sapiens
cacgcaggtgctagaagtggacttggggttgatggacaacaggtgggaggtacggactctggggcagccttcctttcaggcatgtatgcccatgccagtccctacctagggccaggcatgctggttcagggaggctgtctacccaggctctctggccctccctcctcccctgcccttctctttcttttctcctggtcctcaccatcggtctctgtcacagagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgaaaactgtgt

SEQ ID NO: 362932 - DNA, 602 bp, Homo sapiens
cctgaccctggttccaataaaactttatttacaaatcagacagtcggcccgtgggcgatagtttgccaatttgatttttaaaaccatcccattaagatattttttggattattgagtttttggatgcctccttaaatttgtgcctcacttgcttcaccctagtcctaacccagctgtcactgactgccagagccctgatggaggagcccatgttcttacaagggtctgcacctgctgtggtttgaatgtgttccccgtatttcatgtgttggaaactgaatgcccaacttagcagtattgaaagatggggcctttaagaggtgattggatcctaaggcctctgccctcatgaattgattaatccacgtgtggactaatagattaatgggttattatgagagcaggactggtggctttataagaggaagagagacctgagctagcacacccagcccccttgtcacatgatgccatgtgccgcctcaggtctctgtagagtccccaccttcaagaaggctgtgcccccaccagatgtgccccctcgaccttgtattcctccataacagtaagaaataaactccttttctttataaattacccag

SEQ ID NO: 362933 - DNA, 461 bp, Homo sapiens
gcttgggagggagtggggattagctgagaaggggagaaggaagcatttttgaggtgacgtaaatgtttttgtatcttgattatggtggctgttatgggggtgcacatccaagtgtcaagactcatcgaactgtacacttttgttctaggtacattagacctcaataaagtggattttaaacctaaataagccaggtaacagctttgcctgggtggctgggggagaggcttgggacactttacattgatctccctcttaggcatgttcgttttggtttggttttgttcttatgatgtattatttattcaaaaatatatcattagcagagtgactgatgtaaatgtaaaaccattgttaaggaaaccaacaaaagcgggaacaagagacactggtgcatcctgttagagggataagaataagcactcgctgtccaagctcataaaatattttggaaatgaatg

SEQ ID NO: 362934 - DNA, 414 bp, Homo sapiens
tgttatctaagcaacaatgtgtttggtatgaaaaccagtttcgcatgttcaacctaagttacatgctgctgaatggaacctttcatagaaggaaaggaaaccagaagtgtggcttttagttcttcgtttccttgagccaaaacctcctcctacaatttttctaaatatttgtttaactctgttaaagtttattcattattttgcaaatacactaaatacgtcaaactgtttcaatttttagctggtactaaaaaagttagaatcaaatttttccatagtatttcataggagaaaaacacttttagtcactgtggttgtacagacatgatcattcatgtgtgaattgttttattagagatgacaataaagttaaaaaccagcttttccagggttctggataagtgaagggattgg

SEQ ID NO: 362935 - DNA, 444 bp, Homo sapiens
gctggaagccaagatgaggaggtggcagagattcaggccagagttgtgggccgccgtcggcagcaagaacagagagagaggtggacagatctgagagatactgagattaaaaggagcccaagccccatctcatcctagcacaccctcctccactgtcctggcagtagcagtccctgcactaggtcagacaatcccctttggggtacaggaaacaaagcaggaggagtttgaggtccctacactgcagcagaagaagaggaaggagtggggcctgaattgaccataaaggatgtaggggccacgttgttccactgtaatgtcaaggagggggtggccattgtttgtcccagcctggggctccccctctggtttcctatttgtagttactagaatgaaaaaaaaacatgatagataaataaataatccactggcagagatcagaga

SEQ ID NO: 362936 - DNA, 336 bp, Homo sapiens
cagtgaaggtgtggcagctgagcacagagttcacggaacaagggccccgggaagctgaggacctggactgcctggcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggtgtgccgagccttgtgtttctgacgcaagccaaatgaagaaaagcaaagctttggggga

SEQ ID NO: 362937 - DNA, 1968 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttgggggaaaaaaaaacacacacaaaaactcgcagggg

SEQ ID NO: 362938 - DNA, 1689 bp, Homo sapiens
aattacggctaggtacgaggctgggtggtgagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362939 - DNA, 1712 bp, Homo sapiens
ggacgcgtgggtccggacgcgtgggtccggacgcgtgggtcgacccacgcgtcagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362940 - DNA, 1554 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcggccagaagttaactttcccacgggtcatctcctgtgagtgtcctccacgatctccgaggcggacgacggcttcccgttcctgggccctgattcgggtccaagttggggcggccgggcggttgcgccggagggtttcacccaccttccaggtggcccttggggagagaacacgttg

SEQ ID NO: 362941 - DNA, 1909 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362942 - DNA, 1122 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccagggtgtggtgccgagctgggcagcacgttccggtgctggtgtggccctccggacggccatctgccggatcggc

SEQ ID NO: 362943 - DNA, 1620 bp, Homo sapiens
gctggaagccaagatgaggaggtggcagagattcaggccagagttgtgggccgccgtcggcagcaagaacagagagagaggtggacagatctgagagatactgagaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362944 - DNA, 1713 bp, Homo sapiens
gtgaagcgctggtgtttgcggcgctggctgacatgtcgtggtgttgctgatgctgtgccctggtgtgccgtgtggctgtgccatgtggcctgcatgcatgtgactgatgacctctgtgtgttgtgtgctgtcctgtgcccgtctgcagatgtgaagtgtgcctagtccatgtgtgcattcctgctgtgtggatgactgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362945 - DNA, 1828 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362946 - DNA, 1828 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362947 - DNA, 1351 bp, Homo sapiens
cctggggaccattttccagagaatgccacacccttggggtgctagagtggagtgtgggccacttcaatacccagagtagtgtctggtggtgacaaggacacagcgagtgtgtccggggctagtggggagagaggtggggtgggtgataggagccccacccaggggcacagccggctcaagcctgtccctgcacaggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362948 - DNA, 2341 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggccacagggagctttccatgggccctttggcccggagacaggaaggcgggccctgaccctctcagtctggagcccaggtgaaggtctgcagtgagccctgaggggtggaactcgggggaggagtctggaagggggccagggtcggggccaggactgggggctgtggagaggccagaagaggcaggtgcccttgggaagccgtcagtggtagggggcaggcaacgctggagggagctgccaggtgcagggcaggggtgtccggcaaagctccctggggtacaacaggggagctgggggctaggactctccctctgtggggatgacttccagccaagtggctctgccgcctggccctggccctggccctgtaggtgggctggggcgggtgtttggccaggaagtcaggctgggggtggggctgagcctctgcccaggtccactgtccctgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362949 - DNA, 509 bp, Homo sapiens
tggccccctgcatcccgtctaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362950 - DNA, 411 bp, Homo sapiens
gctggaagccaagatgaggaggtggcagagattcaggccagagttgtgggccgccgtcggcagcaagaacagagagagaggtggacagatctgagagatactgagattaaaaggagcccaagccccatctcatcctagcacaccctcctccactgtcctggcagtagcagtccctgcactaggtcagacaatcccctttggggtacaggaaacaaagtccctacactgcagcagaagaagaggaaggagtggggcctgaattgaccataaaggatgtaggggccacgttgttccactgtaatcattgtttgtcccagcctggggctccccctctggtttcctatttgtagttactagaatgaaaaaaaaacatgatagataaataaataatccactggcagagatcagaga

SEQ ID NO: 362951 - DNA, 232 bp, Homo sapiens
aaaaaaaaaagaaaaaaactataatagatatgaacaaaacctaattgggctacagaaaatggaacaaatacatctacttgcagattaaaaggagcccaagccccatctcatcctagcacaccctcctccactgtcctggcagtagcaggtatggccatctgcgggggtgcttattctcaaaaatgtccccagcccagcctgtgtctttgtcactccatggagctcacactca

SEQ ID NO: 362952 - DNA, 522 bp, Homo sapiens
gggtggaactcgggggaggagtctggaagggggccagggtcggggccaggactgggggctgtggagaggccagaagaggcaggtgcccttgggaagccgtcagtggtagggggcaggcaacgctggagggagctgccaggtgcagggcaggggtgtccggcaaagctccctggggtacaacaggggagctgggggctaggactctccctctgtggggatgacttccagccaagtggctctgccgcctggccctggccctggccctgtaggtgggctggggcgggtgtttggccaggaagtcaggctgggggtggggctgagcctctgcccaggtccactgtccctgcaggagggctgtacagtggtgaggtgttggtgtgggacctgagccgtcttgaggacccgctgctgtggcgcacaggcctgacggatgacacccacacagaccctgtgtcccagggtcagggcaggggctgccgggcggggtgggccctgaggcagagctggggagagggcgcccac

SEQ ID NO: 362953 - DNA, 1938 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362954 - DNA, 2046 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttgggggaaaaaaaaaatattaattaaaaaataatgaaataattaaaaattaattcctcgaggggggggccccggtcccccaattcccgcccttattgggggagttctgttttttt

SEQ ID NO: 362955 - DNA, 1710 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362956 - DNA, 1756 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagagcatccccgcgggggagaccgaggatggggcagccacggcagagaactactccagcttatgacccataagagcagaacaatactgggagaaccgggaaagggcggaatacccgcatcaacatgtaccctgggacaagcttggaagaggcaagaccctaacagacggatgcccaggatcagagacccaatgcagagaccccagaacaggtgataaacctattttaccgcccaaaggagcggtacccaatctactctttgcatgagctggtaccccacattatcaacaggagatactcctattacattggaagcggcacgggagacaatcagcagggggaagttggtcccaaccttagtgtcaccaaatgcataggaagaggcccccacacccagttggaatacccggctgagaagattacacgcaaaagaagtaacagaacaggcgcagcagcatgggtacccccaaagtgggcagccacgggacatacggacagaagacgaatctgaacagagcacacggaacacagtgatgggacc

SEQ ID NO: 362957 - DNA, 1651 bp, Homo sapiens
aattacggctaggtacgaggctgggtggtggagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362958 - DNA, 2451 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggccacagggagctttccatgggccctttggcccggagacaggaaggcgggccctgaccctctcagtctggagcccaggtgaaggtctgcagtgagccctgaggggtggaactcgggggaggagtctggaagggggccagggtcggggccaggactgggggctgtggagaggccagaagaggcaggtgcccttgggaagccgtcagtggtagggggcaggcaacgctggagggagctgccaggtgcagggcaggggtgtccggcaaagctccctggggtacaacaggggagctgggggctaggactctccctctgtggggatgacttccagccaagtggctctgccgcctggccctggccctggccctgtaggtgggctggggcgggtgtttggccaggaagtcaggctgggggtggggctgagcctctgcccaggtccactgtccctgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362959 - DNA, 2083 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggccacagggagctttccatgggccctttggcccggagacaggaaggcgggccctgaccctctcagtctggagcccaggtgaaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362960 - DNA, 1911 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccactgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362961 - DNA, 1744 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgaaaagttgccagacggccagcattgccactgccagtgcatccgcccaggccaggaatcatgtggacgcccaggtgcagacggaggcccccgtgcctgtcagcgtgcagcccccgtcccagtacgacatacccaggctcgcagcctttcttcggagagtggaggccatggtcatccgagagctgaacaagaattggcagagccacgcgtttgatggcttcgaggtgaactggaccgagcagcagcagatggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcaaccgtcggccgtggtggaggtccccagcgctgtcctgtgtctggccttccaccccacgcagccctcccacgtcgcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362962 - DNA, 1143 bp, Homo sapiens
gctggaagccaagatgaggaggtggcagagattcaggccagagttgtgggccgccgtcggcagcaagaacagagagagaggtggacagatctgagagatactgaggtcttgcaggaggcgctgcgaccaattcaaacatggcgccgtcagcctcacattccccgttttccgctcatggcggcgtaggggcggaggtcgcgcctgagtgcgtccgcacgagagggcggaaccgtctccatggcaacccgcgcgcagccggggccactcagccaggcgggaagcgctggtgttgcggcgctggcgacagtcggggttgcgagcggcccggggccggggcggccagggccgctgcaggacgagaccctgggtgtggcgtccgtgccctcgcagtggagggccgtccagggcatccgcggggagacgcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362963 - DNA, 667 bp, Homo sapiens
tcgcctccggtcacacggcccctgcaggcgtggagggccgtgagcacgggattgccgtgctggaatgtaaagtacccaactcccgcatccccacggcctggttccgtgaggaccagcggcagctcgcccctggcagctcgcccctgagttaactcaggggcgagctgcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctgaggggtcccgggaggcgggtgcaagccttcgctgtgccgagccttgtgtttctgacgcaagccaaatgaagaaaagcaaagctttggggga

SEQ ID NO: 362964 - DNA, 402 bp, Homo sapiens
catatatcttatggcttatcaaaccttctctctggggctgtttctttttcctaaattatatcctgtagaagtgttgttactgagggtttattaacggtaaactgtttttgtttgtccaaaaatgtccttcgttcttaaaagatgtcctggctgggcacagtgcctcacacctgtaatcccagcactttgggaggtcaaggcgggtggatcacctgaggtcaggagttcgagacaagcctggccaacatggtgaaaccctgtctctactaaaaatacaaaaattaggccaggcccggtggctcacgcctgtaatcccagcactttgggaggccgaggcaggcagatcacgaggtcaggagatcgagaccatcctggctaacacggtgaaaccctgtctccact

SEQ ID NO: 362965 - DNA, 1379 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccggtgagcgagcgccctatagctgggccggcggcgcagccgctgctgagtcacgggcacgctggagatggcgcggcggccgcggacgagctggggacgcagatagggcggctggtgacccttacttgttcacgagtccagaccagcgtcggctcacgatgccggagtcatccagcctcccgcccctgccccagccgccgccacttcggggccttggctgcctgttccgtttagcctgtttgttttacagagttccctttccgagttcgttttgccgaagttcgttttaccgaaatctggatgatgctgggggtcgggagatgcggctagctttagttggccctgacccccgcccccaagctcgtgtctgtcacttcgttttgaagttcgttttgccgaaatctggataaagccagggtggggcggaggcgggctagcttcatttggctctgacccccgaccccagggtcgtatcttcatttgactcagttgatttcactgaaatgtgaataatgcaaagtgactgatgtctggatgatgcttgggtggggcggagtgggctagctccatttagccccgccccaaggctatgtttatcttcgtttgaccgaattggtttcaccgaaatatggatgatgctggagtggggtgcagggtggctaccttcatttggccctgaccccggccccagggtcgtatttatgtttatcctcgtttaaccaagttgatttcaccgaaatgtgaatgatgcaaagtgaatgatgcctggatgatgccggagtggggctaagggggctagcttcaatttggccctgacccccgcccccagggtcgtatctatgtttgtcttcatttgaccgagttcctgttatcgaaatctggatgatgctcagcaccccgaagggcttcctggatcagctgtggttttaacccattaacatttttaaatgggaatctgattagactccgtctcaaaaaaaaaaatgtatatatagatgaggtttcagtttttatttaaaacacgaggccgagcatggtggctcacgcctgtaatcccagcattttgggaggctgagacgggaggatcgcttgagcccaggagttcgaagctgtcgtgagctgagatcatgccactgcactccagcctgggtgagagtgagaccctgtctccaa

SEQ ID NO: 362966 - DNA, 1164 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagacgacagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaacta

SEQ ID NO: 362967 - DNA, 1093 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagacgacagaagggcaggagaaagaagagagcaaaaaggataggaaagaggacaaggagaaagataaagataaggaaaagagtgatgtaaagaaagagg

SEQ ID NO: 362968 - DNA, 1296 bp, Homo sapiens
gttttttttgccgttttttttttgtttgcttttgttgttttcttcctgttcttctccccttgtgttgctttgggttttttgttgcttttttgttttgttttgtttttgtgtggtgctctttttgtgtttgcgttttgttgtgatgtgatttttgttccgcggggggggtgtgtttttcggtttttgtttttcccctgagttgcgcggggtgtgtttgcgtgctgtctgctcattttttcggtttgtgtgttgtttgtcccccgtttttccgccgtgggggtgttgttttgtgtgccccttcgtgcgtgtcttttttgttttcgtgtgggtgggtttggtcgccccgttttgtgctcgctcccccccccgcgcgtgaggtggggtccttgcccctgtttctcccccggttctctcccgtggttctccccctcttctctcttttggttggtcgctcgcgcccctgcctctatcgtttgttttatatttcctccctcctgttgtggggcgcccccctttttccctgagagtgggggtgcgcgctgggggcgctctcccgtggaggtatttttggcgcgcgcccgccccctctcttttttttttttttttttttttttttttttttttttttttttttttttttttttttttttttttttttttttaaaaatcaagccatttaattgtatctctgttgataataccacaccatgttctggacccatagctctggcatcctcaggggttgtgatccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtccgtcatctctgaagtccccagaacagtgtttcaaaagggacacatttaccacactgcagcaagttgtaagtacctcagaccacaggccaaacaggcatgttactaagaatggaacaatgtttcccccaagataagtgcacaggactcctagaggaacaaattaaataaggcactaaatcatttgacatacagtagtcacggatattaaatttcctctcttgaacagatagaacctctcaaatgcacta

SEQ ID NO: 362969 - DNA, 2160 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagacgacagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtccgtcatctctgaagtccccagaacagtgtttcaaaagggacacatttaccacactgcagcaagttgtaagtacctcagaccacaggccaaacaggcatgttactaagaatggaacaatgtttcccccaagataagtgcacaggactcctagaggaacaaattaaataaggcactaaatcatttgacatacagtagtcacggatattaaatttcctctcttgaacagatagaacctctcaaatgcacta

SEQ ID NO: 362970 - DNA, 1609 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagacgacagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgattttt

SEQ ID NO: 362971 - DNA, 1499 bp, Homo sapiens
tggcggtgttctagaggatcccggatggcgacatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagacgacagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgattttt

SEQ ID NO: 362972 - DNA, 1057 bp, Homo sapiens
  misc_feature (4)..(4): n is a, c, g, or t
  misc_feature (843)..(843): n is a, c, g, or t
  misc_feature (952)..(952): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagggtggtgattggtaatcttttgtttgcatgttnagtgctcccttaaggacctcttgtaaggtaggcctggtggtaacagaagcccttagcatttgcttgtctgaaaaggattttatttctccttcacttatgaagctgagtntggctgaatatgaaatactcagttggaatttctttactttaagaatgctgaatataggcccccaatctcttctggcttgtaggcgtactgttgcaaggtctgctg

SEQ ID NO: 362973 - DNA, 1666 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagacgacagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgattttt

SEQ ID NO: 362974 - DNA, 1612 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagacgacagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacgttcagacccttctgaactctgttgataataccacaccatgttctggacccatagctctggcatcctcaggggttgtgatccagctccatatattgtttaccttcaaagatacaattaaatggcttgattttt

SEQ ID NO: 362975 - DNA, 961 bp, Homo sapiens
  misc_feature (4)..(4): n is a, c, g, or t
ggangaggggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccgaatcggcaaggttggaaaccagaagcgtgttgttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagtccatgatgatggaactccaacctcgaaaacatttgaacacgtgaccagtgaaattggagcagaggaagctgaggaagttggagttgaacacttgttacggtgagaccctagtacagcatcaaaatcattcactgcccgagaggtcacacagtgtaaggaagaggtctgtgtcgggaatatggagacctggggtctcgtcctggccgtccactaacaagtctgccattctgagcaaatcacagtccctttccagacctttgttttattgtctgtaaattgaagtgtttgaactacatcaactgtaaaatgtcttgagttacaatttatgactttgtggatagcataccttgtctggaaactataatgttgactgacgggaagaggttatgaaataa

SEQ ID NO: 362976 - DNA, 616 bp, Homo sapiens
tgtataatatttgatggtacctaaggtgcctaagaagcttttttgaaggtagcttttaagttctaggaagtcttttgttgaatttccttgtattggtttaaagccctaaataccatagattttatttcctctcttggaaaaaagatggaagtgacatggcagtatttcctgctgttctccagttacttcacaataccaaaataaattaaacgtactgttgcaaaactcctatgagaaatcactattcaaaaaatggtgccagcttgctgtttaatggtacaactgaagaggaaggagccttcccatttccataaaagaggcaaaggagtcatacccacatagcactactgccagtcactcttgccttcacagggtcacctctcctcacagaaagcagactggacaaatatcagggcccacctccctccaacatggaaacaagtccccctaagaaagagctgagactagtgtgctaatacctgttgtattttgtggagataaaggtgcaggagaataaactcctttataaagaagtgtctttcaggtgttctgaaaccctgccttgttacttacctttattaaaagaaccgaaataatgcctaactcagccaaacaa

SEQ ID NO: 362977 - DNA, 609 bp, Homo sapiens
gagatggagttttgctcttattgcccaggctggagtacaatgtaatgaggcctgatagttaaaaaatcaaaatagagtcctggtgtgcattttaactttgcagttaatgggactggtgattttttccttgttaataagcatgttatataatgttaatcttaactagaggtcctcctgctttatcttaactagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatggtaagtgattttaaaagaaattttccataacagatggaagattatcatgttttcttaaatataagttctttgtaagaatccttttttaaagtggcagaatagagtcttgtactgtgaattctgacttaaaaatataaactgatcctggattgcatgtgggccagaaaaagtttctttttttctttgccacaaagtttattagtggcaaaatttgaataaggacagaattagctagaagtactatgtcaatgttaatatcctaattttaatagt

SEQ ID NO: 362978 - DNA, 2472 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagata

SEQ ID NO: 362979 - DNA, 772 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaatctataagtgcaagggactgtgggttattttaccccccttattagggggcaccactgctgtcgggtctgggggggtgtccccag

SEQ ID NO: 362980 - DNA, 1627 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggata

SEQ ID NO: 362981 - DNA, 1701 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggatagatacctctgtaaaaaaaaaggggggcggccaaattccccaggccagttacggtcccgtttctgtcaaggggcc

SEQ ID NO: 362982 - DNA, 1938 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacaaaaaaaaaaaaaaaaaaaaaaaaaaaaaaaaaaaaaaaaaaaaaaaaaaaaaaaaggggggggggggcaaaaaattccccgcgggagggggccccacagttatcgcagcaccccgccgtcgtcgttgtgcaccagagaggggcccccacaagaggagggagctgctacatatagtaaccaactgcaggacggcgggcgccgcgtttacaaaacagcggcggagacgaggggcgcaacacaccgcggcagccgcgcgcgggacacacatcggggcgggagcaaggacacccccccaacccagcgggggggggggggcacaacaaactggggcgcgcacaccatccccccccagaga

SEQ ID NO: 362983 - DNA, 2710 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggtaaaaataaagatataggttctgttttcatatggttgatctgtattccaatagttaatttttccttctctttaaacaggttcaactccaatttgtgaagatattggtaggcaaatgttatgctataatagaaggattcccatccctgagcttgaagcaagaattgatgtaagtagtcctgagttactattgggtcatgtgtaaaaagatccttgttacaaaagctgagaatatgtatctttcatcttgctttagttttaaaaagttccaggtatagactttgtttttactacaaacagctgaatgacagtgtcttccatatttcaggctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagata

SEQ ID NO: 362984 - DNA, 1861 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgtaagtagtcctgagttactattgggtcatgtgtaaaaagatccttgttacaaaagctgagaatatgtatctttcatcttgctttagttttaaaaagttccaggtatagactttgtttttactacaaacagctgaatgacagtgtcttccatatttcaggctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggata

SEQ ID NO: 362985 - DNA, 1940 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggtaaaaataaagatataggttctgttttcatatggttgatctgtattccaatagttaatttttccttctctttaaacaggttcaactccaatttgtgaagatattggtaggcaaatgttatgctataatagaaggattcccatccctgagcttgaagcaagaattgatgtaagtagtcctgagttactattgggtcatgtgtaaaaagatccttgttacaaaagctgagaatatgtatctttcatcttgctttagttttaaaaagttccaggtatagactttgtttttactacaaacagctgaatgacagtgtcttccatatttcaggctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggata

SEQ ID NO: 362986 - DNA, 1069 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacctctcctcacagaaagcagactggacaaatatcagggcccacctccctccaacatggaaacaagtccccctaagaaagagctgagactagtgtgctaatacctgttgtattttgtggagataaaggtgcaggagaataaactcctttataaagaagtgtctttcaggtgttctgaaaccctgccttgttacttacctttattaaaagaaccgaaataatgcctaactcagccaaacaa

SEQ ID NO: 362987 - DNA, 1396 bp, Homo sapiens
actctattaggatcccctgtcggtcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagata

SEQ ID NO: 362988 - DNA, 152 bp, Homo sapiens
gttggactctggattgatgctggaagtagatacgaaaatgagaagaacaatggaacagcacactttctggagcatatggctttcaaggcaagttgtaagactttacaaaaatgcactctctttaagagataataagcacaaagtctcattct

SEQ ID NO: 362989 - DNA, 532 bp, Homo sapiens
ccagttagatctggaacttgagattgaaaatatgggtgctcatctcaatgcctatacctccagagagcagactgtatactatgccaaagcattctctaaagacttgccaagaggtactgttattatttatacagcagataatgtaattttcatgagaatcaggaattatttagtactatttttattatgtctgttgtaaaagagtaagttccagaaatgtgaaaaagcgaaactgaattctgggtgagggtacagctgatcttattttttttctaaatatgacaaatagtaaattatggatgatggtttttcttaatatgtagcaataaaatagagattatttggtgggaataaaatattttgtcaggacagcagtttgttagttaccatgtttgtagactgttttgactctcttaaaagttattacacaaaacatttcccagtggaagaattaacaacaaaatttagcagttttagagctaattggtaaactcattatttttgtttagagagatagtctcgctctgtcacc

SEQ ID NO: 362990 - DNA, 332 bp, Homo sapiens
ggaaacagcctctaaggatattcactattttccacacactccatttttctttctgtattttggacatgtataattaaaattctcttggaatttttttttccttgcagaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggtgagaaaaatagctttaagtaatttaaattttgcctttaattcgttttaaactagttttttat

SEQ ID NO: 362991 - DNA, 1702 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggata

SEQ ID NO: 362992 - DNA, 713 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcgaaggccttagggatatttacccacctttaaggggcaagattgtgctgctgctgctgaggtgtttccatgaaga

SEQ ID NO: 362993 - DNA, 1624 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacaacgacattgataatactgtatcccggcggtggggggggggg

SEQ ID NO: 362994 - DNA, 2547 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagata

SEQ ID NO: 362995 - DNA, 2785 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggaggtgtttcccatgatgaattgcttgacttagcaaagtttcatttcggtgactctttatgcacacacaaaggagaaataccagctctgcctccctgcaaattcacaggaagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggtaaaaataaagatataggttctgttttcatatggttgatctgtattccaatagttaatttttccttctctttaaacaggttcaactccaatttgtgaagatattggtaggcaaatgttatgctataatagaaggattcccatccctgagcttgaagcaagaattgatgtaagtagtcctgagttactattgggtcatgtgtaaaaagatccttgttacaaaagctgagaatatgtatctttcatcttgctttagttttaaaaagttccaggtatagactttgtttttactacaaacagctgaatgacagtgtcttccatatttcaggctgtgaatgctgagacaattcgagaagtatgtaccaaatacatttataataggagtccagctattgctgctgttggtaagcctggcttcttttcttctatgcaaaaagttggccaagtacttttaattaactcttctttttaatccttaggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagata

SEQ ID NO: 362996 - DNA, 2359 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggattgatgctggaagtagatacgaaaatgagaagaacaatggaacagcacactttctggagcatatggctttcaagggcaccaagaagagatcccagttagatctggaacttgagattgaaaatatgggtgctcatctcaatgcctatacctccagagagcagactgtatactatgccaaagcattctctaaagacttgccaagagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaaatctataagtcgtaaggacttagtggattatataaccacacattataaggggccaagaatagtgcttgctgctgctggagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagata

SEQ ID NO: 362997 - DNA, 1699 bp, Homo sapiens
  misc_feature (9)..(9): n is a, c, g, or t
  misc_feature (42)..(42): n is a, c, g, or t
  misc_feature (71)..(71): n is a, c, g, or t
gggccagantgctgcgtgcggagtgccctgtgatgctgactngcaagttcattcgtgactcgcaccacaangagaataccgcttgcctcctgcaattcacggagtgagattcgtgtgagggatgacaagatgcctttggcgcaccttgcaatagctgttgaagctgttggttgggcacatccagatacaatctgtctcatggttgcaaacacgctgattggcaactgggatcgctcttttgggggaggaatgaatttatctagcaagctggcccagctcacttgtcatggcaatctttgccatagctttcagtctttcaacacttcctacacagatacaggattatggggactgtatatggtttgtgaatcatccactgttgcagacatgctacatgttgttcaaaaagaatggatgcgactctgtacaagtgtcacagaaagtgaggttgcacgagccagaaatcttctgaaaacaaacatgttgttgcagcttgatggttcaactccaatttgtgaagatattggtaggcaaatgttatgctataatagaaggattcccatccctgagcttgaagcaagaattgatgctgtgaatgctgagacaattcgagaagtatgtaccaaatacatttataataggagtccagctattgctgctgttggtcccattaagcaactaccagattttaaacagatacgcagtaacatgtgttggcttcgtgattaaaatgctcctaatcaagattgtttgaacacatgtatttataaaacagagctagagaaaaataaaaatgaacatgtatatacatttggaaatttgaattaaatactgtatcatactttcaaaggataaaaagactacccctctgaaggttgttttgtattaatggtcagtctttgttctctgagaaattatgttggaagcagcatactttcaaattattaccatgagtataattttaagaatgaaaatgtttacagtattttcagttttattataaaaatgcacacacaacaaagattgtcatttcttggctctacttgcattcagcacttgttcttgagcagctttctttgcttttaccatctcgacaagttcctaggaagggagaaaggtgtgatttaagaagttgcgatttaaaaacagacattttaatctagtgtttggtgtaaagaattcaagcaactaagatagatagtactaaatatactgatttcattatctgccagggcctagaaagtttctaaggttgctcatttcttcctcataatattgaccccataactactggttttgaaataagcactatattattaaccacttaatagacataaaatatgagctatatcacccaagctacaatttaaaatacaacaatctataaacgcttaagtctgcaaccttgtatcgtttcatgcagtccttctttgtcctgccaggcaccgcttctgctattttttcccatctttcaggtgtatttactgggtatgttttcaaagcttgttccaaaagcttctgttcttctgttgtccaaggggtgaagtctgtatatggacctgattaagaaaaatttttatttgaaaactgtctttgaacatgttctcagacaagtcttgtggtccacaagtattcgctaagtgcccatttcaatctgggatgtgtcattttgaaaataaacttgtagagatgagagata

SEQ ID NO: 362998 - DNA, 1445 bp, Homo sapiens
atccttcatcctctaccttccttctagcagaaatggcggctgcggcggctcgagtggtgttgtcatccgcggcgcggcggcggctctggggtttcagcgagagtcttctaatccgaggcgctgcgggacggtcattatattttggagagaacagattaagaagtacacaggctgctacccaagttgttctgaatgttcctgaaacaagagtaacatgtttagaaagtggactcagagtagcttcggaagactctgggctctcaacatgcacagttggactctggcattgatgctggaagtagatacgacacatgagaaagccatatgctcccggcctgcggcggctcgacgtggtgtcgtcatccgcggcgcaggcgcgacgcgaatctggaggtattcagcgcagagtctatctaactcccgagagcgctgcagcggaccggaccacattactatccgtccgcgacgagcacacagacttaacagaacgcttaccaccaggcctgctctacaccaaatgttgttcctgcaactggttccctgcaacaccacgaagtccacaagtgtcgcacgacacagcgccacctcagcagctacgccctgtcgcggagagaaactcctcgggctttcatcgaaagcattgccagcaacgcatggaacctcctgggcatacagcatagcctggcgaagctactaattcccgaacacccctgcacgcacgcatacccatcggacacacgccccacctccctctgtgacgcccataattggaactaccaacacagtcggcagacaccaacaggatacagagaaaatccccacgccgtacggaattcatgcggacaccattggaagacatatgagaaaaattaacgcgggactggcactaccgacagatccaaccgctcactacaacccctcacaacagaaaggagaccagaacgacggcacaacaactactctcccaacacagcactatctccactcatacaccgtacaactagcaccaacatgcacaagccatcacaaaacaaaaattcctcaacccaatcagtcaacacaaacccccaccacacacaaccaacatgaccacaacccacacatcaaacaacttggacatccattacatacctctcattaactaacaaccattaactcactagacttcacacgacaatatgaccaaccctcacattctatcacataaaatcatcacatccaccaacactatatcaccaccattaccacaacacacccattatctcgccattccgcgacacccttgacacccgtcacctacatctcgacgcactcacactgaatacctccacacacatcatcctcaacctcttaactggacacatcccctcgaacatatttgcacaccaccatatatagtgcactccacacaacaactactaattgcatcacttctaccacaccac

SEQ ID NO: 362999 - DNA, 3274 bp, Homo sapiens
gcctctctccatcagacaccccaaggttccatccgaagcaggcggagcaccgaacgcaccccggggtggtcagggacccccatccgtgctgccccctaggagcccgcgcctctcctctgcgccccgcctctcgggccgcaacatcgcgcggttcctttaacagcgcgctggcagggtgtgggaagcaggaccgcgtcctcccgccccctcccatccgagtttcaggtgaattggtcaccgagggaggaggccgacacaccacacctacactcccgcgtccacctctccctccctgcttcctctggcggaggcggcaggaaccgagagccaggtccagagcgccgaggagccggtctaggacgcagcagattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacaaagttttggttgctttaacatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaataataaagatcatgtaaaagtaacaaatgtgtgaaatttaaagattgtaaatatatatttacttttttaagatcaaagtttaaacccggtggttagaattttgtgtgtttttaaatactttttatctttttgcatgcctttttttaaaaaccaactagaacttttcattatatcagaatatctgattacatttataattcaattgtgacttgaactgtatcttacaggaatgttcaatttctatacatattttataaggtattaaacctggtgttttctttccataataacctgtttgatgttattagtgctgttaacacacagcaatggaaaaccacactcaggagttgtatctgttgttgtttatactcctttggatgctgtgctggttagtcgtttcccattcctttggctgtaagaatgctgatatgtctgggaatagaatgctataccacgaaataccaaataatttcaaatggtgcccttaaattgtatcacttttttaaaaattcagattcttattagtaaaattagttgatagcactgtgctgaccaagttgattgtgatcatcccagcttagacttttctaaaaacttttttttagaataatctataaactgaactttagtatgcatttcagatatttaggtatataa

SEQ ID NO: 363000 - DNA, 2661 bp, Homo sapiens
tttagtagagatggggtttctccacgttggtcaggctggtctcgaactcctgacctcaggtgatccatccacctcggcctcccaaagtgctgggattagaggcgtgagccactgtgcccggcctataatttttgatagatgattttgaattattttccagagataaaattttaaatgtttccattatatcactgatttatttctgcaaattgaataaattcttaattttctgcatgcacataatacaaaaggtattttcatagttttggatttataccaaatgaaaaggattctcttgatgagcacctttaactgatttttctgttaaagttttaacaatttgttcttggaagtcagttcgtgaaggcaagtttgtcagtattttcacaaaactattcagctgaatccagaaagtgaaacagcaagaatttgcattgtaaaattgtgttataaaattggactttgaaatttcaaaaataagaaaaattttcatgtgtatttatactaaataccgttttaggaaactaggatcagggtgtttctgttggcgttggcattaactagctggatgtaaatttgaaaagccactcaagcagcttcctagtctagaaagtcagaggtttagattagatttccgacatcccttccatttctgacctgtagttcttgtctggaattctgctttgttataaactattgttctaaggagtttgttgtgatagcacatagttcattttgtaaagattccctgcgtataaagtgatgccctacatatgtgattttgtattaaaagtatataggatcattattttattttgaaaaatttaaatacagaaaagtataaaatataagtaccatccgcccagaaataacatgtgttaatgttttgtcatatgtgctttatattttttgaaataaagtgaagtcaactagtatttatagtaaataagttacatacacataagtacatatatgatatttaatcctcacaacgatcttttgacatgtgaccatttcttattcttcttttatagacaaggaactaatgatatgatagattaactggctgttgtcacactagcaagtggcaaaacaagggattaggatcttagtctcttcaactgttagattctatacttccatcctgtgttgactttgttaatggattggataatgtgagatcactctgatgtaaataaagtatcctatattaatttcgagtgcattttaagtacttgtaacataaatgcttcctgtgaaacatctgtaaagacctgaatgggtacatgtgtgtaaagaagaatcagggcagaaaagtgcttttatcatggctccggggaccttagcttcagttggtgttgtgagaattcctcacacaaggacattctccttgcttcagcatcaggatggaagtgtttctcatctggactttttcaaagactcagctggaggaatcagaattcataatttcctggcagctcatgattctgctacactacaccatgccatctcttgtgtgaaaggacagatttgatggaggactatgtcatccctcatgcgtttcttattgtctacatttattctaatgggaagaagtgagcaaaaacacctcaataatttgggtagtttttagaaaaccttgttagtaaattagaatagtgccactttggcattatgagaaagaagcatggatacataactagggttttgtgtatgactacaacgaaatgcagaatggtgtctccaaaaggtttccagttgctgccacaagaactgcttggtattgcctacatgtgttgtcctatttttgctttgcccttctgcagttacttgctgtgggaccttggagaaattaacttagcctctctgtacttcagttttttgtatttgtaaaaatatatttgtaataatctcatagttaagaaggtagttaatgtgtgactcagtccttgtctaaaagtaaatatgcctagctacccccatcttccaaagccagaaggtgaaactttaacaagttttctaaaagcaaattgtgttttttaaaagtgcatgtgtcatccaatcccatatgattgatctgtgctgggtgcagccttagaatgtaaattcttttgaattctaggcagagaatgcaggattggcattctaaatatttgtacatgataaacaaatgcttctttaggttacagcaaatagtttacttatcaagatcacgattgttagatactgttgtcaattacagaggttttagatgaggctttctggaatgatttagtttccctgtaagggagcctgtctattggaatagacaggttcacttctcccagtctttcaagttgcatgctttttatatctgattccactggctgagctgattgtgaatgtcctaaccctgttgattgtgtctggccactcatgggcaaagaacagattatccattctttatagttgtcttttagttttacaagttgaaaaaacatctgagtaggttagataatttattctaccactttgtaaatgattagaatatgtcagtcataatcatgccaagagattatggatttatgcatattttgttttgctgtagtaccattcctagttgaatcttaacatccatgtctaaaatctatacagaacaaatattacagttgggaaaactgt

SEQ ID NO: 363001 - DNA, 383 bp, Homo sapiens
atgtctgagcagaatgggttgtggctagaggccaataatcttatgttttaacaagccctccaggtgattcctgtgcacagataagctttagtttcatttacccaatggtttaaattattccaaataagttgtgttctttctgcttactaccaaaaaatgctaacttgaaattattttcatgttcatttcagcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgc

SEQ ID NO: 363002 - DNA, 4584 bp, Homo sapiens
gcctctctccatcagacaccccaaggttccatccgaagcaggcggagcaccgaacgcaccccggggtggtcagggacccccatccgtgctgccccctaggagcccgcgcctctcctctgcgccccgcctctcgggccgcaacatcgcgcggttcctttaacagcgcgctggcagggtgtgggaagcaggaccgcgtcctcccgccccctcccatccgagtttcaggtgaattggtcaccgagggaggaggccgacacaccacacctacactcccgcgtccacctctccctccctgcttcctctggcggaggcggcaggaaccgagagccaggtccagagcgccgaggagccggtctaggacgcagcagattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacaaagttttggttgctttaacatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaatattgttctaaggagtttgttgtgatagcacatagttcattttgtaaagattccctgcgtataaagtgatgccctacatatgtgattttgtattaaaagtatataggatcattattttattttgaaaaatttaaatacagaaaagtataaaatataagtaccatccgcccagaaataacatgtgttaatgttttgtcatatgtgctttatattttttgaaataaagtgaagtcaactagtatttatagtaaataagttacatacacataagtacatatatgatatttaatcctcacaacgatcttttgacatgtgaccatttcttattcttcttttatagacaaggaactaatgatatgatagattaactggctgttgtcacactagcaagtggcaaaacaagggattaggatcttagtctcttcaactgttagattctatacttccatcctgtgttgactttgttaatggattggataatgtgagatcactctgatgtaaataaagtatcctatattaatttcgagtgcattttaagtacttgtaacataaatgcttcctgtgaaacatctgtaaagacctgaatgggtacatgtgtgtaaagaagaatcagggcagaaaagtgcttttatcatggctccggggaccttagcttcagttggtgttgtgagaattcctcacacaaggacattctccttgcttcagcatcaggatggaagtgtttctcatctggactttttcaaagactcagctggaggaatcagaattcataatttcctggcagctcatgattctgctacactacaccatgccatctcttgtgtgaaaggacagatttgatggaggactatgtcatccctcatgcgtttcttattgtctacatttattctaatgggaagaagtgagcaaaaacacctcaataatttgggtagtttttagaaaaccttgttagtaaattagaatagtgccactttggcattatgagaaagaagcatggatacataactagggttttgtgtatgactacaacgaaatgcagaatggtgtctccaaaaggtttccagttgctgccacaagaactgcttggtattgcctacatgtgttgtcctatttttgctttgcccttctgcagttacttgctgtgggaccttggagaaattaacttagcctctctgtacttcagttttttgtatttgtaaaaatatatttgtaataatctcatagttaagaaggtagttaatgtgtgactcagtccttgtctaaaagtaaatatgcctagctacccccatcttccaaagccagaaggtgaaactttaacaagttttctaaaagcaaattgtgttttttaaaagtgcatgtgtcatccaatcccatatgattgatctgtgctgggtgcagccttagaatgtaaattcttttgaattctaggcagagaatgcaggattggcattctaaatatttgtacatgataaacaaatgcttctttaggttacagcaaatagtttacttatcaagatcacgattgttagatactgttgtcaattacagaggttttagatgaggctttctggaatgatttagtttccctgtaagggagcctgtctattggaatagacaggttcacttctcccagtctttcaagttgcatgctttttatatctgattccactggctgagctgattgtgaatgtcctaaccctgttgattgtgtctggccactcatgggcaaagaacagattatccattctttatagttgtcttttagttttacaagttgaaaaaacatctgagtaggttagataatttattctaccactttgtaaatgattagaatatgtcagtcataatcatgccaagagattatggatttatgcatattttgttttgctgtagtaccattcctagttgaatcttaacatccatgtctaaaatctatacagaacaaatattacagttgggaaaactgt

SEQ ID NO: 363003 - DNA, 4327 bp, Homo sapiens
agtccccggctgagcgctggcggtcggtgcggcgtcaggtgcgcccgccaggtgagcgcgctccctggcaccgttggcccccggagggtcgggcccagttgcggcgagcggattggtttatcttggaagctaaagggcattgctcatcctgaagatcagctgaccattgacaatcagccatgtcatccaggcctcttgaaagtccacctccttacaggcctgatgaattcaaaccgaatcattatgcaccaagcaatgacatatatggtggagagatgcatgttcgaccaatgctctctcagccagcctactctttttacccagaagatgaaattcttcacttctacaaatggacctctcctccaggagtgattcggatcctgtctatgctcattattgtgatgtgcattgccatctttgcctgtgtggcctccacgcttgcctgggacagaggctatggaacttcccttttaggaggtagtgtaggctacccttatggaggaagtggctttggtagctacggaagtggctatggctatggctatggttatggctatggctacggaggctatacagacccaagagcagcaaagggcttcatgttggccatggctgccttttgtttcattgccgcgttggtgatctttgttaccagtgttataagatctgaaatgtccagaacaagaagatactacttaagtgtgataatagtgagtgctatcctgggcatcatggtgtttattgccacaattgtctatataatgggagtgaacccaactgctcagtcttctggatctctatatggttcacaaatatatgccctctgcaaccaattttatacacctgcagctactggactctacgtggatcagtatttgtatcactactgtgttgtggatccccaggaggccattgccattgtactggggttcatgattattgtggcttttgctttaataattttctttgctgtgaaaactcgaagaaagatggacaggtatgacaagtccaatattttgtgggacaaggaacacatttatgatgagcagccccccaatgtcgaggagtgggttaaaaatgtgtctgcaggcacacaggacgtgccttcacccccatctgactatgtggaaagagttgacagtcccatggcatactcttccaatggcaaagtgaatgacaagcggttttatccagagtcttcctataaatccacgccggttcctgaagtggttcaggagcttccattaacttcgcctgtggatgacttcaggcagcctcgttacagcagcggtggtaactttgagacaccttcaaaaagagcacctgcaaagggaagagcaggaaggtcaaagagaacagagcaagatcactatgagacagactacacaactggcggcgagtcctgtgatgagctggaggaggactggatcagggaatatccacctatcacttcagatcaacaaagacaactgtacaagaggaattttgacactggcctacaggaatacaagagcttacaatcagaacttgatgagatcaataaagaactctcccgtttggataaagaattggatgactatagagaagaaagtgaagagtacatggctgctgctgatgaatacaatagactgaagcaagtgaagggatctgcagattacaaaagtaagaagaatcattgcaagcagttaaagagcaaattgtcacacatcaagaagatggttggagactatgatagacagaaaacatagaaggctgatgccaagttgtttgagaaattaagtatctgacatctctgcaatcttctcagaaggcaaatgactttggaccataaccccggaagccaaacctctgtgagcatcacaaagttttggttgctttaacatcatcagtattgaagcattttataaatcgcttttgataatcaactgggctgaacactccaattaaggattttatgctttaaacattggttcttgtattaagaatgaaatactgtttgaggtttttaagccttaaaggaaggttctggtgtgaactaaactttcacaccccagacgatgtcttcatacctacatgtatttgtttgcataggtgatctcatttaatcctctcaaccacctttcagataactgttatttataatcacttttttccacataaggaaactgggttcctgcaatgaagtctctgaagtgaaactgcttgtttcctagcacacacttttggttaagtctgttttatgacttcattaataataaattccctggcctttcatattttagctactatatatgtgatgatctaccagcctccctattttttttctgttatataaatggttaaaagaggtttttcttaaatattgttctaaggagtttgttgtgatagcacatagttcattttgtaaagattccctgcgtataaagtgatgccctacatatgtgattttgtattaaaagtatataggatcattattttattttgaaaaatttaaatacagaaaagtataaaatataagtaccatccgcccagaaataacatgtgttaatgttttgtcatatgtgctttatattttttgaaataaagtgaagtcaactagtatttatagtaaataagttacatacacataagtacatatatgatatttaatcctcacaacgatcttttgacatgtgaccatttcttattcttcttttatagacaaggaactaatgatatgatagattaactggctgttgtcacactagcaagtggcaaaacaagggattaggatcttagtctcttcaactgttagattctatacttccatcctgtgttgactttgttaatggattggataatgtgagatcactctgatgtaaataaagtatcctatattaatttcgagtgcattttaagtacttgtaacataaatgcttcctgtgaaacatctgtaaagacctgaatgggtacatgtgtgtaaagaagaatcagggcagaaaagtgcttttatcatggctccggggaccttagcttcagttggtgttgtgagaattcctcacacaaggacattctccttgcttcagcatcaggatggaagtgtttctcatctggactttttcaaagactcagctggaggaatcagaattcataatttcctggcagctcatgattctgctacactacaccatgccatctcttgtgtgaaaggacagatttgatggaggactatgtcatccctcatgcgtttcttattgtctacatttattctaatgggaagaagtgagcaaaaacacctcaataatttgggtagtttttagaaaaccttgttagtaaattagaatagtgccactttggcattatgagaaagaagcatggatacataactagggttttgtgtatgactacaacgaaatgcagaatggtgtctccaaaaggtttccagttgctgccacaagaactgcttggtattgcctacatgtgttgtcctatttttgctttgcccttctgcagttacttgctgtgggaccttggagaaattaacttagcctctctgtacttcagttttttgtatttgtaaaaatatatttgtaataatctcatagttaagaaggtagttaatgtgtgactcagtccttgtctaaaagtaaatatgcctagctacccccatcttccaaagccagaaggtgaaactttaacaagttttctaaaagcaaattgtgttttttaaaagtgcatgtgtcatccaatcccatatgattgatctgtgctgggtgcagccttagaatgtaaattcttttgaattctaggcagagaatgcaggattggcattctaaatatttgtacatgataaacaaatgcttctttaggttacagcaaatagtttacttatcaagatcacgattgttagatactgttgtcaattacagaggttttagatgaggctttctggaatgatttagtttccctgtaagggagcctgtctattggaatagacaggttcacttctcccagtctttcaagttgcatgctttttatatctgattccactggctgagctgattgtgaatgtcctaaccctgttgattgtgtctggccactcatgggcaaagaacagattatccattctttatagttgtcttttagttttacaagttgaaaaaacatctgagtaggttagataatttattctaccactttgtaaatgattagaatatgtcagtcataatcatgccaagagattatggatttatgcatattttgttttgctgtagtaccattcctagttgaatcttaacatccatgtctaaaatctatacagaacaaatattacagttgggaaaactgt

SEQ ID NO: 363004 - DNA, 2404 bp, Homo sapiens
  misc_feature (5)..(6): n is a, c, g, or t
ggcgnngcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcaccgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcattt

SEQ ID NO: 363005 - DNA, 343 bp, Homo sapiens
agcccccgcagggcccgtgacgccgcggccgatgtggccgcgcgcgccctacgggcctgcaccgccaccgcacaaagacgcctcgggagccgccgcctgcacccgggccgcagcagccacgccagccggagcccggcattttaccctccagattcccaatctatttttaaaaataatgttcaaaacatatgggaaaaataagtgattgctccttttcatggtcacagattgtatttattttttcagactggttttccaacctaacgagggaatgggtagtgaatgttgttgttgttgttgttgtttatgttggttaatttcgaaataaaactgtttaactcgt

SEQ ID NO: 363006 - DNA, 3233 bp, Homo sapiens
  misc_feature (5)..(6): n is a, c, g, or t
ggcgnngcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcaccgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggcgggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcct

SEQ ID NO: 363007 - DNA, 1762 bp, Homo sapiens
agcccccgcagggcccgtgacgccgcggccgatgtggccgcgcgcgccctacgggcctgcaccgccaccgcacaaagacgcctcgggagccgccgcctgcacccgggccgcagcagccacgccaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcaccgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcattt

SEQ ID NO: 363008 - DNA, 1606 bp, Homo sapiens
  misc_feature (5)..(6): n is a, c, g, or t
ggcgnngcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggcgggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcct

SEQ ID NO: 363009 - DNA, 824 bp, Homo sapiens
  misc_feature (5)..(6): n is a, c, g, or t
ggcgnngcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggtaggcgtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatgtcggagaagacataaaggacacatgtgagagactgcatgtgtgagcacatgtatgtgcacgagccatgcctgcaaaggtgcagagagcgtgtatgtgcgcatgcatgtaagataacaggtgtaaccatgtgtgaaccgt

SEQ ID NO: 363010 - DNA, 834 bp, Homo sapiens
  misc_feature (5)..(6): n is a, c, g, or t
ggcgnngcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagaggtaagtaagcactttctctccttcctccactccttcagtcccttttgggtgagtggtccctgaagacaggccttcagggtcctggcactaccccgagttcctgtgtgcatcttttctacatcacaaaggagctgtttggctttggacaggcttcaacttgtctgagcctcagtttcctcatctgtaaagtgggtgaaataacaaggtctactcaaaacctgtctcttagtattccatgagccagtgaggcaagctcttagtgtggtgcctggcacgtggtggctttataccaccggcaagctgccgagggtcccgtggaattgacatcttgtgcctcattgcaggccatgagcttcctaggatttaatttataggagtatgactgaggggtgacacagagaggcccatgccagggaaagaaggctttattaattttcttgaaaggaggggacatgctacgccatgcagggccacctgggaattactagatttggacaagcaggagcaggggtggaagaaaggtgtaagttagaagctgcatcacagcttccgtgggaaagtctcgacatccaggtgctgtggctcacgcctgtgatcccagcatttgggaggctgaggcaagagaatgcttgagccctggagtttgagaccagcctgagcaacatagtgaaactccatctct

SEQ ID NO: 363011 - DNA, 382 bp, Homo sapiens
acccctcgcccttgagctccactggccgctgcagggtcactgtggtggtgatcaggccccgctccggacagcgactagcccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgaggtgatggaggctgcagggcaggcagg

SEQ ID NO: 363012 - DNA, 2451 bp, Homo sapiens
tcctttgttcagatttcgtcacgaatgaaatctaactttgagccaacccctgcaggacacccaacaccttcatgattctgactctggctcccgcctcaacatgggtcctgcctcacatggccctcacctgtacaccccctctcctcccaacaagcgcctggccaggcgcttgttgggacagcttttctggttgttgccggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcaccgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacagggccttcgagacccagatgacgcgcctggaggctgagttcgtgcggcgggaggcacccccatcctatggtcagctcatcgcccagggcctcattccacccgtggaggactttcctgtctacagtgcgtcccaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcattt

SEQ ID NO: 363013 - DNA, 2653 bp, Homo sapiens
  misc_feature (5)..(6): n is a, c, g, or t
ggcgnngcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagcggcctgcagtgggaagctggagcagcacacggagcggcgtggggtcatctacagcccggcctggcccctcaactacccgccaggcaccaactgcagctggtacatccagggcgaccgtggtgacatgattaccatcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcaccgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggcgggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcct

SEQ ID NO: 363014 - DNA, 570 bp, Homo sapiens
  misc_feature (5)..(6): n is a, c, g, or t
ggcgnngcccgcgggcggccgggcccggcatggagaagcgcgcggccgcggggctggagggcgcgccgggcgcccgggcgcagctggccgtcgtctgtctggtgaacatctttctcaccgggagactcagcagtgcggttcctgccttagaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggcagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcattt

SEQ ID NO: 363015 - DNA, 702 bp, Homo sapiens
gcttgtctcctcatctccttgtctgcttccggagcctgagtttcagggtttatatgggcacaggataggtggcatggcaggccaaaaacaacttttggggtgcaaaaacaggaatccctgtccccatttagggctgtagattcccgggcttgagggtgaggcctttgccaggaaactaccttcttctacccagggtttccctgtcttctgtccatatcacaatgttcttagaaggataagaaaagacacaaaagaaagcctgacaagtttgctaatgtctggggtatatgagagttggctcgccccatgatgggctccaattaaattcatctctgtcttcctcatgtgccattcttccctggctcacattagaaattcaggagcggagaacaaagcagccaagtttgtttttccagagcaagaggggtctggtgaaagcagtcctgacagctgcaccgtgtgtcttggtgaactaacggcttttacgtgtttcattcaagactgtttagtctgcgtgctaaggattcatatatcagtttttggctctagtgacattgaggtagtttgatttccaatgatttcgttgtcatctgtatttgcctacagtgaaagaaataactgagagtcgagttagtgcagggtcacttaaaagcttgcctttcttcattcactctccttaatgatattgccagtgcttctaaa

SEQ ID NO: 363016 - DNA, 466 bp, Homo sapiens
ccagtgctgtgctgagggtaagggcacccagcgcaagccccagcgcagctgcctgtccagccctgcctcagctccttgcacagaatgagcttgaagtgctcccctctgctcggttctagttctgcctctgacagttttgctctttggttcacaaggcttcctaaactcaggattgctttgtgggtctgttctttgggatgagaggccagggcaggtgcaagctatgccttcactcctttgtccctgccttcctccttcctgtaccccagctacagccccgttgggaagaatgtgtcgttagtcacaaagcattgcagatgtgtctaagaaatgccacgctggggccgggcgtggtgctcacacctgtaatcccagcacttcgagaggctgaggcaggcggattgcctgagctcaggatttcaagaccaccctgggtaacatggtgaaaccctgtctctactaaaaa

SEQ ID NO: 363017 - DNA, 110 bp, Homo sapiens
acctcatctatactacaaattaaaaaaaaatttagctgggcatggtggtgcacacctaagtcgtccctagtagtagtccctagctactcaggaggatcactggagttcag

SEQ ID NO: 363018 - DNA, 2098 bp, Homo sapiens
caatcgcgaaagtgtgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagcc

SEQ ID NO: 363019 - DNA, 1104 bp, Homo sapiens
taagagtcaaatcaagaaatactcaaaacttctgttgaataaatggtagttggctgtcttgaaaggcaacaaccagctgactgcaggatggcaggatggcaggcttcctattatttattttaaattgcagtcatttttgcgttgtagtttgaggtctagacttttataggaagtctttttctatgtatgtcacccataacaatatctgtttaaaaaaaaaaagacagttatcaatctgaagcaagtaagtcggtccgtctggggattatatagcccctttgtttttcttttttggctgtctgccttgtaatgatttgctgatcattagtactagtgtctctaagtcaggaaaatactcgaagaaatgttgaagtattttagttgccttcaagaactttgcttccactaagtgatttggtaaaaaaaaaaaaaaaaagagagattgaaattatggggtaagagattatgtaacagattatatcctacttttctgttacaatagataactgagagaagattatgcatttacagcatatctttttgtctcatctaaaatcatttccagctcagttgtttgctattcatattatttggttttcatcgtgatctttcttctgcagtttttgtggttcttggaacttgtattgcagtgcagctggggacaaaccctgattggatgtttttttgttgttttgcggggacatttatgttctattgtgcgcactggcaaacgtatgtttctggaacattgcgatttggaatgtaagtaatacttaatggtaatttttgttttctctttcacatatggagaatgttgccttataagtatttgagtattagaaattgatcaaatcactaagttagtttaataaattaaaaaatttatgcttcattattatagctatttcctaatagtctctgcatatgtccctctattatacttttttaaaaggagatatcagaacctcccagccagtattttaaaagcaatacaaaaagcagtagcccctcatctttgtctttcccacagaaaaattcactttttttccccaccattatttaccttaattccatttttattttcacatataaaaatgcatttcc

SEQ ID NO: 363020 - DNA, 584 bp, Homo sapiens
taatttggttattcagtttatttacattctcagtctcaatctggacactcaaattaaggcttcttgtgaaaagcatcttttgtagggttagttgacatgatacatccctttctttctcagacgcatttcatattgttgggtttttagttttgggaattcaacagctattcctaaataattattggaagttgatatctgagcacaatatgatttactatgtagttcacaattgtcctcttatgaaaatgcctacgttattctgttttattcataggttgcacacatgacgaaaagtgaaatgcatttgcatgacacagcattcataggtccggcacttttgtttctggaccagtattttaacagctttattgatgaatatattgtactttggattgccctggtaggtattgtactaagtcttatttcatggtttgagggtttgaaggttgcttgttttcttattttgatgacccagtcatgaaagatcgttcatataattgtaatgatttggaatgtcagaaatccacataaatggggctgtgtgagagttctatggctttatatttgagccttttattttttgc

SEQ ID NO: 363021 - DNA, 3233 bp, Homo sapiens
caatcgcgaaagtgtgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaactgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363022 - DNA, 3257 bp, Homo sapiens
tggagacattggggtggcggagcgccggcgcgggagccggggggctgttgtgtgggagcccaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363023 - DNA, 3328 bp, Homo sapiens
cgaagcactaggccgtttgaggatctccgctccgctttgcctgggaccaggaaaagacgcgagagacggaactcggcatcaggcactgcttggggcaggaggagagtaggggaaaccaaggaagagaacagaaaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363024 - DNA, 3253 bp, Homo sapiens
taagagtcaaatcaagaaatactcaaaacttctgttgaataaatggtagttggctgtcttgaaaggcaacaaccagctgactgcaggatggcaggatggcaggcttcctattatttattttaaattgcagtcatttttgcgttgtagtttgaggtctagacttttataggaagtctttttctatgtatgtcacccataacaatatctgtttaaaaaaaaaaagacagttatcaatctgaagcaagtaagtcggtccgtctggggattatatagcccctttgtttttcttttttggctgtctgccttgtaatgatttgctgatcattagtactagtgtctctaagtcaggaaaatactcgaagaaatgttgaagtattttagttgccttcaagaactttgcttccactaagtgatttggtaaaaaaaaaaaaaaaaagagagattgaaattatggggtaagagattatgtaacagattatatcctacttttctgttacaatagataactgagagaagattatgcatttacagcatatctttttgtctcatctaaaatcatttccagctcagttgtttgctattcatattatttggttttcatcgtgatctttcttctgcagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363025 - DNA, 3223 bp, Homo sapiens
atgatttttaaaattcagtacaagtgtatttcattttaaatgatagatattgtgtttgcaaaaatgcatgacatcaatccactctgtcccccccacttcaggtaaataaacacattttcagtatactttatgaatatattattcacttttctgaaaagtacatttaaacttcaaaattttgtatgcacaatagtagaatctgtttgaatgtacttgacctgttttttcttctgcattgtgaatgccttcttaattgccttctgcttttactagctgcctgtatcctaacaatttggagttgggaactcttctgaatagaaattttatcttccattctctatactctgcagatttttatatctagtcgcaacatttctattatgattcatacttcctcacaacaattatgaatgttctacagatttagaggtagaattcaaaaacatatacaaggaaaaaggcagggtgcactccttttattaaaaggccagaacacatcctggttcactgttgcaagaccactgggatgcattaggtgaatctaacttagcttgtgacacaagttaataaagttgaatctggtttttttgttttttttaaggttgatggctgaagtgagattaatttctaaatagtctcaactcttgagacttgctatattgcttataatgaagaggaaaaggacactttcattactttacgtatttatgtaattggagggaatggaaagtttttgggaatatgaatcaaatattagactgttttcttattttagtttgtatatgttttaattgttttctctctctacccattaaagattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363026 - DNA, 3703 bp, Homo sapiens
atgatttttaaaattcagtacaagtgtatttcattttaaatgatagatattgtgtttgcaaaaatgcatgacatcaatccactctgtcccccccacttcaggtaaataaacacattttcagtatactttatgaatatattattcacttttctgaaaagtacatttaaacttcaaaattttgtatgcacaatagtagaatctgtttgaatgtacttgacctgttttttcttctgcattgtgaatgccttcttaattgccttctgcttttactagctgcctgtatcctaacaatttggagttgggaactcttctgaatagaaattttatcttccattctctatactctgcagatttttatatctagtcgcaacatttctattatgattcatacttcctcacaacaattatgaatgttctacagatttagaggtagaattcaaaaacatatacaaggaaaaaggcagggtgcactccttttattaaaaggccagaacacatcctggttcactgttgcaagaccactgggatgcattaggtgaatctaacttagcttgtgacacaagttaataaagttgaatctggtttttttgttttttttaaggttgatggctgaagtgagattaatttctaaatagtctcaactcttgagacttgctatattgcttataatgaagaggaaaaggacactttcattactttacgtatttatgtaattggagggaatggaaagtttttgggaatatgaatcaaatattagactgttttcttattttagtttgtatatgttttaattgttttctctctctacccattaaagattccagtgctgaatattcaaatgaaaatttttcctgcactttgtactgtagcagggaccatattttcctgtacaaattacttccgtgtaatcttcacaggtggtgttggcaaaaatggatcaacaatagcagtaagtataccttaagattttcaacacttgtttacactaggacttggttttgttgtcattttgttttttatttcaaatgtataaaatcatttgttaatttataatttatacttagcctttaaagaaactaatgttcaaaacttcaattttatatatacttacccacatttatatgctttatatattcatacttttatgcatacacacacacaaacacacttattcacatgttttttaaagtatgagctgctttgtaaaaataagcctggtctcttaagtgaaatcctcagtttgtgcctaatgaatttatgctgctacttttcattagctcttctagtttgtgatttatagaaattgctgcctatcaggcaccatgaggttcctgaaagtttgagttgaactgtgaactgttctgcagcagatccatgtagtatctgatgagtactgaatactattaactcttctcttcactctgtacagggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363027 - DNA, 2612 bp, Homo sapiens
gttctaagatgtctaccctcctccacccaagacagaatcgatcatctttgacacctacctgcttagtctcctgaatctgctactgagtgtaattccccttattggcaacaccactcaccagaattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363028 - DNA, 2389 bp, Homo sapiens
taatttggttattcagtttatttacattctcagtctcaatctggacactcaaattaaggcttcttgtgaaaagcatcttttgtagggttagttgacatgatacatccctttctttctcagacgcatttcatattgttgggtttttagttttgggaattcaacagctattcctaaataattattggaagttgatatctgagcacaatatgatttactatgtagttcacaattgtcctcttatgaaaatgcctacgttattctgttttattcataggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363029 - DNA, 2250 bp, Homo sapiens
atattgtctgtggctggtttcatggtacaatggcagagttaagcaactgtgacaaagacaataaggcccataaagcttaaaatatttgccatctgtctctctaacaaagagtttgtatgtgaaggaaagattgcaaggaaattgaattattttatggaatggaaggtgaatctgtagagagaacagagtccagtcctctttactttcaggaagcttagggagagcctaaacgggtgctgagaatgtctcttttctttccaggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363030 - DNA, 1597 bp, Homo sapiens
caatcgcgaaagtgtgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttatccaggtcagcggtggtacaacggtaatgagtagcgagcagcgcgcgggatgcttc

SEQ ID NO: 363031 - DNA, 1270 bp, Homo sapiens
  misc_feature (12)..(12): n is a, c, g, or t
tactactactantaattcgcggccgcgtcgaccaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363032 - DNA, 831 bp, Homo sapiens
caatcgcgaaagtgtgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggtaagagtttcttaacagatctcaacatttgctatataccaaaaacgttgtaattgggatcgtggggtcattttaactaaagataaagtaatctgacagctgtcaactattttaaaatatcacacacactgtgataaagcttgtaagtacagcctacacacttgcttattggaaaccagaagcaaacggtagactgtgatcctagtgcttaaattaatgttagcagggattaacatgtaaaatgttccttttaaagtcactaaatctcaattttttacaaaaaagtttttcatttttttaaatggtagaataaagtcttagc

SEQ ID NO: 363033 - DNA, 3290 bp, Homo sapiens
caatcgcgaaagtgtgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363034 - DNA, 3770 bp, Homo sapiens
caatcgcgaaagtgtgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcagtaagtataccttaagattttcaacacttgtttacactaggacttggttttgttgtcattttgttttttatttcaaatgtataaaatcatttgttaatttataatttatacttagcctttaaagaaactaatgttcaaaacttcaattttatatatacttacccacatttatatgctttatatattcatacttttatgcatacacacacacaaacacacttattcacatgttttttaaagtatgagctgctttgtaaaaataagcctggtctcttaagtgaaatcctcagtttgtgcctaatgaatttatgctgctacttttcattagctcttctagtttgtgatttatagaaattgctgcctatcaggcaccatgaggttcctgaaagtttgagttgaactgtgaactgttctgcagcagatccatgtagtatctgatgagtactgaatactattaactcttctcttcactctgtacagggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363035 - DNA, 3179 bp, Homo sapiens
gaggcaatgagggccagcaggagtctcgcgcgcctgcgacgcgggtaagcaccagccacaaaaacctacaaaagaagggaaattactgtctttaaatattacacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaataattgatgtgactgaagtgcaaatcttcataataatcatgcatttgctggcagtgattggaggaccacctttttggcaatctatgattccagtgctgaatattcaaatgaaaatttttcctgcactttgtactgtagcagggaccatattttcctgtacaaattacttccgtgtaatcttcacaggtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363036 - DNA, 2342 bp, Homo sapiens
ctagctgagacactctcttaacctccaccgctacacgtggtgttggcaaaaatggatcaacaatagcaggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggttgcacacatgacgaaaagtgaaatgcatttgcatgacacagcattcataggtccggcacttttgtttctggaccagtattttaacagctttattgatgaatatattgtactttggattgccctggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtcctttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatg

SEQ ID NO: 363037 - DNA, 1141 bp, Homo sapiens
caatcgcgaaagtgtgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacagtttttgtggttcttggaacttgtattgcagtgcagctggggacaaaccctgattggatgtttttttgttgttttgcggggacatttatgttctattgtgcgcactggcaaacgtatgtttctggaacattgcgatttggaatgtaagtaatacttaatggtaatttttgttttctctttcacatatggagaatgttgccttataagtatttgagtattagaaattgatcaaatcactaagttagtttaataaattaaaaaatttatgcttcattattatagctatttcctaatagtctctgcatatgtccctctattatacttttttaaaaggagatatcagaacctcccagccagtattttaaaagcaatacaaaaagcagtagcccctcatctttgtctttcccacagaaaaattcactttttttccccaccattatttaccttaattccatttttattttcacatataaaaatgcatttcc

SEQ ID NO: 363038 - DNA, 3062 bp, Homo sapiens
gcgccatggagcagtggcgacagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgattagatacatgcagaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccgtgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagcttcctgtgcttcctacaacttttcttttctcagtcctcagggcctcagctttgcttctcagggcccctccgctcccttctggtcagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctgg

SEQ ID NO: 363039 - DNA, 1623 bp, Homo sapiens
gcgccatggagcagtggcgacagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgattagatacatgcagaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgcaaaaaaacaaaaacaacacaaaccacaccacaagacaacagcaaacacacaggaacagcaccaagggcagtaaaactacacaacacaacgacaaaatggcggcccgcgaaaaaaaatggggcggcaaataaagggtcacccgagtggttcacaacccggggggaaccggttttatccact

SEQ ID NO: 363040 - DNA, 2975 bp, Homo sapiens
gcgccatggagcagtggcgacagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgattagatacatgcagaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccgtgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctgg

SEQ ID NO: 363041 - DNA, 1245 bp, Homo sapiens
gctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgcagaaggccgaagggattttttgtcagataggcaaggtttcggtgggtccaaaaaatgtctatcacaaggcattttttccttttcctctgtcgaaaagttaaaatctctatgtgttt

SEQ ID NO: 363042 - DNA, 1909 bp, Homo sapiens
gcgccatggagcagtggcgacagtgcggccgctggctcatcgattgcaaggtcctgccgcccaaccaccgggtggtgtggccctcggccgtggtcttcgacctggcgcaggcgctgcgcgacggggtccttctgtgccagctgctgcacaacctctcccccggctccatcgacctcaaggacatcaacttccggccgcagatgtcccagtttctgtgtttgaagaacatacgcaccttcctgaaagtctgccacgataaatttggattaaggaacagcgagctgtttgacccctttgacctcttcgatgtgcgagactttggaaaggtcatctccgcggtgtcgaggctctccctgcacagcatcgcgcagaacaaagggatcaggccttttccctcagaggagaccacagagaatgacgatgacgtctaccgcagcctggaggagctggccgacgagcatgacctgggggaggacatctacgactgcgtcccgtgtgaggatggaggggacgacatctacgaggacatcatcaaggtggaggtgcagcagcccatgattagatacatgcagaaaatgggcatgactgaagatgacaagaggaactgctgcctgctggagatccaggagaccgaggccaagtactaccgcaccctggaggacattgagaagaactacatgagccccctgcggctggtgctgagcccggcggacatggcagctgtcttcattaacctggaggacctgatcaaggtgcatcacagcttcctgagggccatcgacgtgtccgtgatggtggggggcagcacgctggccaaggtcttcctcgatttcaaggaaaggcttctgatctacggggagtactgcagccacatggagcacgcccagaacacactgaaccagctcctggccagccgggaggacttcaggcagaaagtcgaggagtgcacactgaaggtccaggatggaaaatttaagctgcaagacctgctggtggtccccatgcagagggtgctcaaataccacctgctcttgaaggagcttctgagccattctgcggaacggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttactcctgcacatctggacgcctccggaagccgggaccaggtcccaaagattggtggccatgccggaattacaatgggcaaccagaccctccccggaagctgtggctgaccttcagacgggagaagtgttaactgctgagggggaacagattccggggggaaggacctggcaaaacagaaccgggatacccgat

SEQ ID NO: 363043 - DNA, 459 bp, Homo sapiens
aactgcaggggcctgagattagctgtgaacatgtgggagcccgatgcatgtgggtcagggatctggggcccccccagctccctgacccacatgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgcaaaaaaacaaaaacaacacaaaccacaccacaagacaacagcaaacacacaggaacagcaccaagggcagtaaaactacacaacacaacgacaaaatggcggcccgcgaaaaaaaatggggcggcaaataaagggtcacccgagtggttcacaacccggggggaaccggttttatccact

SEQ ID NO: 363044 - DNA, 375 bp, Homo sapiens
ggacttggatgtgctgtgtccccagacccagagggcaaggggccctgggattggaggccagtgtgtccctccagagcctttctgcttgacatccttcctctctgggtacagagcagggttctgggcaccaggggagagacccagcttggcccaagggcctcctggatcactggttgggctcctcctgcagctgtgtgatgctgcccatctccctcaacagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacgg

SEQ ID NO: 363045 - DNA, 399 bp, Homo sapiens
gcactgtgtgtcccagatggacaccacaaagcccaggctcagagcaggtggtcagggcaggcttcctggaggaggtgggggcccgtggtaaggagtgggagagagaagggcacagaccttccaggagtggaggtgcacagaggtgaaatatattgccagggtgggggcgtcccatagggaacagtgtccctctcctcccctgctcctgccttgacccctctatctaggaactagtggggacagggagggcggggtgcgttgatgcatgggccacagtcaaagagcagccttccctcatctctgtgttctgtccttctcctgcagatctggacgcctccggagcgggaccaggtgagtcttctggacctgggccctctgctatcacccatgtcagccatc

SEQ ID NO: 363046 - DNA, 1834 bp, Homo sapiens
gctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgaaatgggcagggaagaaaacagggatttcccctctctagatccctgccaggtccctctccaggaggcccctctgctctcctgaagggtggtccctgagggtctgcccagccttggcacgagaggttggttccagcccctggcagggcttccttccaagggcccctgcagcctacaaactgggcctcgggcgactcaaaataagtgctcttgggggtggctctaccccattacctcccccagccacaactcctggccttcgacttctggctgggttagccagaccctggtttctctaccctgatgttgcatgagacctggtaacagtgtctccctcccagctccttgccaaagcctctgttgagacctgggcttcttgtagccccttctccctctggccagctgcacagcctgtgggaggtgcccggcccaggctgggtgtgggggaagctggtccctgctgtgggtggcgctggggacctaggggctccttctgaggttggccttgtggcctctgggctgtatgcctctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgcaaaaaaacaaaaacaacacaaaccacaccacaagacaacagcaaacacacaggaacagcaccaagggcagtaaaactacacaacacaacgacaaaatggcggcccgcgaaaaaaaatggggcggcaaataaagggtcacccgagtggttcacaacccggggggaaccggttttatccact

SEQ ID NO: 363047 - DNA, 1074 bp, Homo sapiens
gctgttcactgtgggcccacttgccccactgtgctagggcgcgggaggagagagcactgtggtcgccctctgcagccactctggctcccaagacttccctgactcccccactcccctccttgccaggggcacacccggaccccacacggcaggcccctctcttgggaggggcctttggaatgatgaaattccaaccctgctgcccggtcagcggtaccgtttcctgccctctctctgagaggccctttctggagtcctgggaaggtgtctgcctggccgcgctgccagatcagtacatcttttgtaaaaaccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaatgatgtatattttagtttgttgacaaataagtcatcatgatcacgaaggacactgagaaaaaataatttagaaccctggtttttgtgaatttttttgttttgtgtttctttgttttgagatttgtgtttggtttggtttttgcactgcactaaggcaggagggttggagggctgggtgcagcctgggagtccgatggttttcagcaggagacggggtgtcccctgcagggggctaaactgcaggggcctgagattagctgtgaacatgtgggagcccgatgcatgtgggtcagggatctgggggcccccccagctggcgggaaccccaaatggacacaaactgtacatttgccaatgggtttttttcagaccatggtttttacttgcaaataaacctgagttcttttctgcaaaaaaacaaaaacaacacaaaccacaccacaagacaacagcaaacacacaggaacagcaccaagggcagtaaaactacacaacacaacgacaaaatggcggcccgcgaaaaaaaatggggcggcaaataaagggtcacccgagtggttcacaacccggggggaaccggttttatccact

SEQ ID NO: 363048 - DNA, 2037 bp, Homo sapiens
ttcaagaccagcctggccaacatggtaaaaccctgtctctactaaaaatacaaaaattagccgggcgtggtggcgcacacctgtagtcccagctactcgggaggctgcggcaagagaatcatttggcctgagaggcagcagctcaaagaagcactggaagccatgcaggacttggcgatgtacatcaatgaagttaaacgggacaaggagaccttgaggaaaatcagcgaatttcagagttctatagaaaatttgcaagtgaaactggaggaatttggaagaccaaagattgacggggaactgaaagtccggtccatagtcaaccacaccaagcaggacaggtacttgttcctgtttgacaaggtggtcatcgtctgcaagcggaagggctacagctacgagctcaaggagatcatcgagctgctgttccacaagatgaccgacgaccccatgaacaacaaggacgtcaagaagtggtcctacggcttctacctaattcaccttcaaggaaagcagggcttccagtttttctgcaaaacagaagatatgaagaggaagtggatggagcagtttgagatggccatgtcaaacatcaagccagacaaagccaatgccaaccaccacagtttccagatgtacacgtttgacaagaccaccaactgcaaagcctgcaaaatgttcctcaggggcaccttctaccagggatacatgtgtaccaagtgtggcgtcggggcacacaaggagtgcctggaagtgatacctccctgcaagttcacttctcctgcagatctggacgcctccggagcgggaccaggtcccaagatggtggccgtgcagaattaccatggcaacccagcccctcccgggaagcctgtgctgaccttccagacgggcgacgtgcttgagctgctgaggggcgaccctgagtctccgtggtgggagggtcgtctggtacaaaccaggaagtcagggtatttccccagctcatctgtgaagccctgccctgtggatggaaggccgcccatcagccggccgccatcccgggagatcgactacactgcatacccctggtttgcaggtaacatggagaggcagcagacggacaacctgctcaagtcccacgccagcgggacctacctgatcagggagcggcctgccgaggctgagcgctttgcaataagcatcaagttcaatgatgaggtgaagcacatcaaggtggtggagaaggacaactggatccacatcacagaggccaagaaattcgacagcctcctggagttggtggagtactaccagtgccactcactgaaggagagcttcaagcagctggacaccacactcaagtacccctacaagtcccgggaacgttcggcctccagggcctccagccggtccccagtgttcacgccccgcgtcatcggcacagctgtggccaggtataactttgccgcccgagatatgagggagctttcgctgcgggagggtgacgtggtgaggatctacagccgcatcggcggagaccagggctggtggaagggcgagaccaacggacggattggctggtttccttcaacgtacgtagaagaggagggcatccagtgacggcaggaacgtggacaagactcgcagattttcttgggagagtcactccagccctgaagtctgtctctagctcctctgtgactcagaggggaaataccaacctcccagtcttccactgcccacagggatagggagggtgttgagaatcctaaactcgaaccgtttcactgtcagcctgccctcggcgacccatcactgggtatgctattgtacatagaggaaacctgggctagccccacccagagcgcagaggagggggcaccgacagcgctgcgagccaggctctgggtagtggctgaggccagaggcccatcgcctgcccctgtccaactgagatggccttcaggagcctaggtttgaacagcagatgctgtcccaggaagggctagggacatcggaggggacctgcccccacaccctctgctcagcccctgg

SEQ ID NO: 363049 - DNA, 501 bp, Homo sapiens
agagctgggttggatggtcatggagggcccagggtgctgccttgccgccctgacctacggttacggggagtggcgtgtcttctgaatgcacaggccttgggggttttgcagctatgtgatgagaaggctgggggcggtggtggctacaccctcggatgtggagctggtctgcctgcttccacttccatccaggcctggcttctcaccccccagccttgggacggggggtttcgtcatctctctgagcccatttcctccttgagaaaacaggaatgagcttggatgtgctggcgcacggaagccagagcttgctgctgttgctgttacggtttttacagagcttacagttttaataagtttttccttgccctccctttgttttttccctttagtttctgtgtttgaagaacatacgcaccttcctgaaagtctgccacgataaatttggattaaggaacagcgagctgtttgacccctttgacctcttcgatgtgcgagact

SEQ ID NO: 363050 - DNA, 228 bp, Homo sapiens
gctgcgggccggggccaagtcagtcaccgagtgagctgctgagtcactgagtgagctgtcctatcctttgcaggtcccaagatggtggccgtgcagaattaccatggcaacccagcccctcccgggaagcctgtgctgaccttccagacgggcgacgtgcttgagctgctgaggggcgaccctgagtctccgtggtgggaggtgggtcctggggcccgggagggtcga

SEQ ID NO: 363051 - DNA, 401 bp, Homo sapiens
ctggggtgtagggaagaggcgggaggagtcatggggatggggagcggcagggggagagaggggccctcgacaaaggcttgggaaatgaggggaggtggaggcagggcaggggaagcgaagagtcagccttggagagagcaccctggggcctccgtgtcggggtacacccagcactttgcgacctgcggcccagcaggcgcggaggatggcggggaggaagccagcagcccctgtgtttactgtcgtcagaaaggtcttgtgttttggttttggggtttttgttttgtttgtgttttgtttggcttgtttgttttttaaggggaaaaaagtttgtaattatttcatccaaatctcccgttatatatctgtgaataataagagattttataatagcaagaaaa

SEQ ID NO: 363052 - DNA, 665 bp, Homo sapiens
ttttttgagatagggtctcattctgtcccccaggctggagtacagtggcgcgatcatggctcactgcaacctcaacctccccgggctgaaatgatccttatacctcagtatccccagtagctgggactacaggagaattgcttgaacctgggaggcggaggttgcagtgagccgagatcgtgccatcgcactccagcctgggcgacagagcgagactccatcttaaaagaaaacagaaaaaccaaaaaaccatagttgcataaccccaaagccactcatgagcaaaactgcaaaaaggacagaggctggggaggctgggtgatgggcggccaccgtaactactcgattgaggactacaaggctggtcatggaactgtggtttcactttggatgagtagagacaggctttttttgtctgccagggaatccacgtagacaccctagtaaaatctgtgttccgtgtacctcctacgcctcctgtggtttgctgatactgcacttttatggtaagctttgtcacacaggtcatagatctgcagcccaagggcccaatccggcccacagacatgttttgtttggccagtatgcagttgtcagtatagtagttcttaaataaattcttagttacttatcagtattcaagaattggaagaggttgggcgtgg

SEQ ID NO: 363053 - DNA, 563 bp, Homo sapiens
ccctggttcttctgcctgcccacaacagactgaaccagcccctgtgggaagagaaagcccccaggctgagaatcaactgagctgcattgaggagccccaggtgtgtgtccaggaatgccaagtgcagaagggctatgcacggggcaccatcatgacctgctgcagagaccgtccctgagaacagaggagcagagagagagaagagcaagagatgggcaaggacagagtcacaatcccagtgtctggcccctgcctccggcttgtctcagctagctctgtcactggactttcatttgtctgggaccaatatctctcttccttcctaaagatgactgcagactggtttctgccctgtgtaatgaaaagatcatgatgtgcacagctttttaccccatcttaagaatatttgaggcacttatctccatagaggggcagaatctgtaatgaatttacttttcagtcctccataacacctgttcgcaaggtttgtacagtttttcaaggaaatactggggtaggatggatggatgggatactgaaaaggacccactaaaatttaatgc

SEQ ID NO: 363054 - DNA, 4767 bp, Homo sapiens
cctgttccggaggcgcgggcggtgccactgtcttggtacctgcggtagtagcctggctttgctctgacggcgatctcgcggcccgagagccttttataggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactag

SEQ ID NO: 363055 - DNA, 318 bp, Homo sapiens
  misc_feature (31)..(31): n is a, c, g, or t
gcgtctcgcccaaaaggaacgcaagaaaggntcgtttagtaatacttccccacaggttataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatc

SEQ ID NO: 363056 - DNA, 646 bp, Homo sapiens
tacgttattaaggagaaggtaaatgggcatggagcatatcactgtcatctgggtgatggttgaggccatagacctcacttattttggtgtccctgtcagtgacagcctctcaggctagttgggtccaacccaggaataagagaggtcaaaagtgaaatgtgttctcaatgtaccgccattccttttgggcagttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatgtgagtgccacacacttttctctcaacctccaggttcagagtttaagtccaagtaaccgtatttgtcctcctcctcattattattatgttctggctaaagaaaccttgtttgctattttaattttttatgctttttaccaaagcttttctgaaggaaaataatttgaaactaagacatgtgaataatgaatttttatgttcaatctatgttcagtggtacccccaacacatacccctccatcctaacactcagctaccacatccctttgtgtgaaacagtaatagaatatgaagatcagttgttgtaaatca

SEQ ID NO: 363057 - DNA, 649 bp, Homo sapiens
acatgcacgtatagtcagatatcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcaggtaagaattattctcctgtaaactcacataata

SEQ ID NO: 363058 - DNA, 4752 bp, Homo sapiens
cctgttccggaggcgcgggcggtgccactgtcttggtacctgcggtagtagcctggctttgctctgacggcgatctcgcggcccgagagccttttatagacagctccttcagtgtctctgtttccaaaccgcaaccgagaagagacagacggagaaaagagagttacttttccaggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcat

SEQ ID NO: 363059 - DNA, 4676 bp, Homo sapiens
cctgttccggaggcgcgggcggtgccactgtcttggtacctgcggtagtagcctggctttgctctgacggcgatctcgcggcccgagagccttttataggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaaggagttacggtttatcggttgttcctgaacctgctggatgcacaccagaattacctggggagattattaaaaatacagattcttgggccccacccctggagattgtgaatcatcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcat

SEQ ID NO: 363060 - DNA, 2870 bp, Homo sapiens
actctcgaggatcccgaggcttcaacggaacttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcat

SEQ ID NO: 363061 - DNA, 4485 bp, Homo sapiens
agagagagagagagagaactagtctcgagcacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctagatggggtttcttcatgttgccaggctggtctcaaactcctgggctcaagtgatccacctgcctcagcctcacaaagcactgggattagaggcatgagccactgcagccggccagaaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363062 - DNA, 2015 bp, Homo sapiens
  misc_feature (36)..(36): n is a, c, g, or t
cggtacccactagtccacggttggctctagaggggntagagggggtgctatagggtaaatacggcccctatttcaaagatttttaggggaattaattctaggacgatgggcatgaaactgtggtttgctccacagatttcagagcattgaccgtagtatacccccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363063 - DNA, 3746 bp, Homo sapiens
agagagagagagagagaactagtctcgagcacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacgagcagtcattctcccaacagcacctgttgtttcctgactgcataatgatcaccattctaatctggtgtgagatggtatctacattgtggttatgattagcatttctctgattagccagtgatgataagacatttttaccatgtgtctgtcggctgcacaaatatctccttttgagaagtgtctgttcatatccttcacccacttttgatggggttgctttgattttttcttgtaaatttgtttaagttctcttgtagattctggatattagccctattgtcagatgggtagattgtgcaattttctcccttcatgtagtgactgtcacg

SEQ ID NO: 363064 - DNA, 3345 bp, Homo sapiens
agagagagagagagagaactagtctcgagcacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctagatggggtttcttcatgttgccaggctggtctcaaactcctgggctcaagtgatccacctgcctcagcctcacaaagcactgggattagaggcatgagccactgcagccggccagaaggccacaatcagagaatggaattcctaggtgactccataatgcaactggtagccacagagtacttattcattcatttcccagatcatcatgaaggacacttaactgactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatc

SEQ ID NO: 363065 - DNA, 1404 bp, Homo sapiens
aggcacagattactgagcaagtaagatactccacagcttgcatgcccgtcctttatagcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363066 - DNA, 1595 bp, Homo sapiens
aagttaaacgacggctagcaaatctgccagagggatgctcaggagagacacgttgaaagccgaggtggagagaaggtggcaccagagggaagtgcccatgtgggttatggaatgacgcaatgcctatacaatccaggaagggacactgaagacagcctcatctggtctttactttgcagttggagaaactgaggctggagagcgcaagtgagtctgctgaggctatacagcactttataccagaacctgggctagaacaagacctctggcctcttggaatgagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363067 - DNA, 1316 bp, Homo sapiens
cttaactctgtctaggcactaagtacatggttttcctcatagttacatagtaaccatgacaaataacactttaccataataaatgttctttcctttccctttcaggactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363068 - DNA, 635 bp, Homo sapiens
tgatgaactttggtacaacgatccaggccaggtgcgtgtttttatgcccttgctgtgaaggttgcaaacccagacataacggttattgctctgggctcagaagatacatgttgcctagtattgaaactgaattttactgtcagggttttgtccttcagagctatttcttttcagcttcaggttagttccaaagcataagcaccagagcagctgtcccttgaatcatttttgatgatgtttgtaaattccatgttggggagaggagtaatggccctgcctcattaaattgcagtagatggaaggagacacatggtaggatgaggagagagaacttggaggtctttttagaagtagttcacctggaaggtatcttgctgcaaaatagtaaataagtcctataagatttcttttttttagttggtaacagtcacaagttctcttccttgttaagcatgtttgagctaaaaacataataggtggacataattatttttatttttaattactgtcttaatatgaagtaatacataataaaattagcattgttaaaaaagatttgtgtcacacagatatataatacatacaaaaattatatctttaatgcatgtaaagttaggaagctaaggcatatctgt

SEQ ID NO: 363069 - DNA, 383 bp, Homo sapiens
gctaggagagtgatgctaaagcacctgcttggtaacattcccaagccacacgtctgtgttttggcatttctgtatgttcggtgcctgctatacccaagttcacatcagatactgaaatttacaatcaggggcactcatccagacttccattatgtttttgagtgatgaaagaataagggaagaaaacagttttctatcttgtgccttataaaatacaattatacacatttcatatgcacgtatatttgtatgtgtatatgtttagttgcattattctttgcactagattattaaatataattttattaaatataaaatatatttccttgtgtcagatataattttccccagatggcccatcagaagcggttcatcgaacggaa

SEQ ID NO: 363070 - DNA, 481 bp, Homo sapiens
ggctaagtgtattggaaactgcaaaatcagtgttatggtaattgcagaaatattttgtagcattggcagtttgggaaacatgtttatgtctgttttattctttctgttttttagagcttatattctctgtggaagatgtgacatatccaggcggaacatcatgatgcagggaaacacatggtgagtgccgtgatgggaatggcaatagtttgggagaaccgagagaggagcagacattggtgctgggctatagagggtggaaaggatttagatacatggggagaggggataatgtgctcattctttcaacagtgggcacaatacaatagagggccatgcccagggctgggaagccagaccagaacagttaatagaaatcccagagcgctgccctgacagcgcttgcagttccgaggtgcaggcagacattaaaggtggaattaggtccttagaaggtggattgtaattattgtaggacctg

SEQ ID NO: 363071 - DNA, 446 bp, Homo sapiens
cagtcccgacaggagaagacaagacagccggtacagatctgattatgaccgagggagaacaccatctcgccaccgcagctacgaacggagcaggtaaaccgcttgtgtgtagttctttaatgaactgcagaggcccaggcacggtcattctccatttatgacaaccaaaccaaaaggatccagtagggcatcttgatttatgtaaggaaaggaagcacattttggactctgttttcaagaggaagaaacaactgacaaataagttgatgtcagaaaaaaattgcttttaaaaagcattccaaatatatcagtgtagattcatttcagtgaatataagacttttactctgcataatacagttgacattttaatgatgatcccatgagatgaaagatcttgtattttttgtgttatcatagattaaattatgttcaatgtgatcatca

SEQ ID NO: 363072 - DNA, 283 bp, Homo sapiens
cttgtccatcctgactctcagcctcaaagtcatagccttccttagaatgatggctttctgccattaagaataatcaaaagaatgtaatgtatgatttgaagaggcctcttaaaataactggttttgttgcattttaggtttacctcctctttacctgagatgtttgcctgtccttttccttaggtaccaaaaactgtggaagagttatgtgaaacttcgccacctcctagcaaatagtcccaaagtcaaacaaactgacaaacagaagctggcacagagggag

SEQ ID NO: 363073 - DNA, 3707 bp, Homo sapiens
agagagagagagagagaactagtctcgagcacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcat

SEQ ID NO: 363074 - DNA, 3359 bp, Homo sapiens
ggtgacttgaggacttcaggcgttgtagtgccgttgcagtgtagggaagccagcctgcccgatggggccatggacagcagtgccacacaccccagctccacaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcat

SEQ ID NO: 363075 - DNA, 4368 bp, Homo sapiens
agagagagagagagagaactagtctcgagcacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363076 - DNA, 4344 bp, Homo sapiens
agagagagagagagagaactagtctcgagcacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363077 - DNA, 2657 bp, Homo sapiens
tagttgatgttgtttaagtctctttaatctgtaggttctcactccatttctcctttttttcccttgcaaacatttgttgttgaagaaattggattatgtgtcctgtagagttcctacagtgtagtctgagttttgctgattgcaactttctggtgtcatttaccagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363078 - DNA, 3557 bp, Homo sapiens
agagagagagagagagaactagtctcgagcacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtgggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtctccccgcctacgaactttttaactgacaggccaactgttatagaatacgatgatcacgagtatatctttgaaggattttctatgtttgcacatgcccccctgaccaatattccactgtgtaaagtaattagattcaacatagactacacgattcatttcattgaagagatgatgccggagaatttttgtgtgaaagggcttgaactcttttcactgttcctattcagagatattttggaattatatgactggaatcttaaaggtcctttgtttgaagacagccctccctgctgcccaagatttcatttcatgccacgttttgtaagatttcttccagatggaggaaaggaagtgctgtccatgcaccagattctcctgtacttgttaaggtgcagcaaagccctggtgcctgaggaggagattgccaatatgcttcagtgggaggagctggagtggcagaaatatgcagaagaatgcaaaggcatgattgttaccaaccctgggacgaaaccaagctctgtccgtatcgatcaactggatcgtgaacagttcaaccccgatgtgattacttttccgattatcgtccactttgggatacgccctgcacagttgagttatgcaggagacccacagtaccaaaaactgtggaagagttatgtgaaacttcgccacctcctagcaaatagtcccaaagtcaaacaaactgacaaacagaagctggcacagagggaggaagccctccaaaaaatacggcagaagaatacaatgagacgagaagtaacggtggagctaagtagccaaggattctggaaaactggcatccgttctgatgtctgtcagcatgcaatgatgctacctgttctgacccatcatatccgctaccaccaatgcctaatgcatttggacaagttgataggatatactttccaagatcgttgtctgttgcagctggccatgactcatccaagtcatcatttaaattttggaatgaatcctgatcatgccaggaattcattatctaactgtggaattcggcagcccaaatacggagacagaaaagttcatcacatgcacatgcggaagaaagggattaacaccttgataaatatcatgtcacgccttggccaagatgacccaactccctcgaggattaaccacaatgaacggttggaattcctgggtgatgctgttgttgaatttctgaccagcgtccatttgtactatttgtttcctagtctggaagaaggaggattagcaacctatcggactgccattgttcagaatcagcaccttgccatgctagcaaagaaacttgaactggatcgatttatgctgtatgctcacgggcctgacctttgtagagaatcggaccttcgacatgcaatggccaattgttttgaagcgttaataggagctgtttacttggagggaagcctggaggaagccaagcagttatttggacgcttgctctttaatgatccggacctgcgcgaagtctggctcaattatcctctccacccactccaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatc

SEQ ID NO: 363079 - DNA, 1842 bp, Homo sapiens
ataggctagtcgaggccggtgttaattggccgaggcaactacaagagccaaatactgatcgacaacttattgaaacttctccagttctacaaaaacttactgagtttgaagaagcaattggagtaatttttactcatgttcgacttctggcaagggcattcacattgagaactgtgggatttaaccatctgaccctaggccacaatcagagaatggaattcctaggtgactccataatgcaactggtagccacagagtacttattcattcatttcccagatcatcatgaaggacacttaactttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363080 - DNA, 1732 bp, Homo sapiens
tacgttattaaggagaaggtaaatgggcatggagcatatcactgtcatctgggtgatggttgaggccatagacctcacttattttggtgtccctgtcagtgacagcctctcaggctagttgggtccaacccaggaataagagaggtcaaaagtgaaatgtgttctcaatgtaccgccattccttttgggcagttgttgcgaagctctttggtgaataatagaactcaggccaaggtagcggaggagctgggcatgcaggagtacgccataaccaacgacaagaccaagaggcctgtggcgcttcgcaccaagaccttggcggaccttttggaatcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363081 - DNA, 1431 bp, Homo sapiens
gtggtttattttaaagtattcttttttccccagcatttattgcagcgctgtacattgataaggatttggaatatgttcatactttcatgaatgtctgcttctttccacgattgaaagagttcattttgaatcaggattggaatgaccccaaatcccagcttcagcagtgttgcttgacacttaggacagaaggaaaagagccagacattcctctgtacaagactctgcagacagtgggcccatcccatgcccgaacctacactgtggctgtttatttcaagggagaaagaataggctgtgggaaaggaccaagtattcagcaagcggaaatgggagcagcaatggatgcgcttgaaaaatataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaacgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtagattgttcagctttcatccggtggctgttcatcaagttatcagctgcaaatattgaacttacctctctctaagcagtgagtgttttgtagaaggaatccgtttaacgattaattggctaatgggagaaggggaaagactgatattcaagtcatacagattctttgaatcattagaataggagagaaatcatgattctaagccaggccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatc

SEQ ID NO: 363082 - DNA, 1352 bp, Homo sapiens
cctgttccggaggcgcgggcggtgccactgtcttggtacctgcggtagtagcctggctttgctctgacggcgatctcgcggcccgagagccttttatagacagctccttcagtgtctctgtttccaaaccgcaaccgagaagagacagacggagaaaagagagttacttttccaggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcagggaaacacatgtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggcaccgagatcacagtcatgggcgaggtgagaggcatcggtccctggatcggcgggagcgaggccgcagtcccgacaggagaagacaagacagccggtacagatctgattatgaccgagggagaacaccatctcgccaccgcagctacgaacggagcagagagcgagaacgggagagacacaggcatcgagacaaccgaagatcaccatctctggaaaggtcctacaaaaaagagtataagagatctggaagtcgctccccagtagggagaagaagagagctgatgggaaagactgcggggatcctcta

SEQ ID NO: 363083 - DNA, 3674 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcccttattgatcacagtgtggtccagagcatggagtcttggcagcttcacccaggaggagacctggacacttgaatgacccccaagatagtcatccaaatgcctggacattctccctagaaatagagccagctggggaaagcaaggcagatcttcagagtctgagcaagcaactcctgga

SEQ ID NO: 363084 - DNA, 733 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccagggccttgctggtgtgacataggcttcagcttcctatctgtttcccctggggaatcaatgaaaacaaggttcatcattcctctaatagattaaaatttttttcttgattaacttcactgtggagttggcaagagttgttatctgttaatcaaaactgtttaaataaaaaataaaaagatcaaactttgagtctt

SEQ ID NO: 363085 - DNA, 1260 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgaggtaggtgtttcctgaggccatcgtgagcctgtggacctaggtaatagcccactgtcttctgtcgctgatgccattttgatgtactctttctttgtattttgagtatttttatatcatagaactgctgattctggatgtgcccacaagcagcttgtatctgttgtttatatgtttactacctttagtggcagttgaagtcttagagctttttcttgtaccttttcccatagacttagatttgtcgtgttttcactactacttttcttggaatagtttaggaacatttcctgggtagccttaagcatttgaaatcaccattggttatggcagagctcttttattaatttatttttgaattcttcattcatttacattgttcagaatgcagaaggatatatagtgaaaaatcgagtacttcccctgagacacctgaggttactagggtcttgtgtctccttccagagatagttaaaacctgtatgatcagacactctcattttcataaatcgtagcatgctataaatgctaggcccatattttattattttattaaagattgtttttctttaaggttcagagggtacattttcatgtttgttacacgggtatattgtgtaatgttggggattgggcttctagtgtatccatcaccaaaatattgaacattgtatccaatagataatcttttaattctcacccccctcactccttctccccttttggagtccccagtgtctattatttctatctatatgtccatgtgtacccattgtttagttcccacttacaaaagttagaacatgtgat

SEQ ID NO: 363086 - DNA, 465 bp, Homo sapiens
ccattaaaacatttctgagggccggcaaattagtcatcaatgctgcaagggttccttgaatcctatgccattaaaaaaaggacaagctgagcgtgtggcaaggtcaaaccgctgattttcccagctgctgcccaataaacctgtgtgccctttggggcagccccagcctcgtgccgaattcggcacgaggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363087 - DNA, 543 bp, Homo sapiens
ttgaagaaatgtgaaattaagaagaaatcttatctaaattatgtttgttgtaatctgtcggcttatatacctacatttaggccttcacagcacctagtggctttcctgttattaaagagaacagcagacttctgtaactacagaagagcttctctgaaactagtgattttaggggactgagaagaaagaggcagatgagatggtgtctcttaaagggttatttcaaagccaaagtttagatgcatttcacatgcagggagtgtgaattgtctgtatcttctatagggtttagtctaatccttttttcctctcgatgtatgggaaggagtcgcatcacaggatgctggcagggccttgctggtgtgacataggcttcagcttcctatctgtttcccctggggaatcaatgaaaacaaggttcatcattcctctaatagattaaaatttttttcttgattaacttcactgtggagttggcaagagttgttatctgttaatcaaaactgtttaaataaaaaataaaaagatcaaactttgagtctt

SEQ ID NO: 363088 - DNA, 253 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtcccagcagggaggtgtgcttggctcagccttaggatttttgaatctgccattgtccccatttcttttacagtcatctatagggtccctccagctttcataatactcacagaggtacaagattatagggtcctagaggctgtctc

SEQ ID NO: 363089 - DNA, 3495 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363090 - DNA, 3170 bp, Homo sapiens
aggatagacttctccatcagatagtcctctgcctggctgtcctttgtgtggacacatgggtaacactggcctcacttccacaagggttctgtcccagagcactctcttgccctcagaggagtgatgtgccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363091 - DNA, 3789 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagccgtgtctggcaaaaaaaaaaaaaaaaaaaaaaaaaaaaaaaacaaaaaaaacacaaacaaaagaagagagaaaaaaaacacacaaaaaaaaaacaaaacaaagatgtgtgtggggggcagccgacgcgcccaacaaaaaaagagagttttgaagaacacaccattagtggggagggcgagggcgagcacccaaacagatgaagtagaaacaccacgtggccaacacaacaggtgtcaccaagaaaaaaagctgtcgggagaaaaacgggggggggatgactaccacaaacaaga

SEQ ID NO: 363092 - DNA, 3443 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctagtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363093 - DNA, 3055 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363094 - DNA, 2897 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363095 - DNA, 2307 bp, Homo sapiens
ttatagaggatcccccgttcgccgcttctcgtttccacagctattggaccaaaaggacaagcagtttgtgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363096 - DNA, 3092 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363097 - DNA, 3353 bp, Homo sapiens
ctggcaaccagtctttattcattttttaaaaaaggaaatccaaataagttagcaaaaaaaaaaaaaaaaaaaaatacaaaacaatggcaaaaccacacgatgctttgttaacaaaagaaatcacccccaagaggccccaaccccttttccctgcctgtccccggcaacttcagcacaggagaccttggtcggatggcagctttacaaacaacacacgaaacaaaacaaaacataaaaccactggaaggttcccaatattcactgcaaaagtttggccccccagggacttgggaacagagggctgttcctctccccttcttctctctcaattcagggcaggcccagcccagccactggcatcgggaagagaccagaacaggagacgtgcacagcttgtccaggtcagggcactgcgtctctcaaaccgtttcacttggggggtggaattagaggccgcgttatgataaaaaggaagctcctgagtttgccccctgagctggggcatacacgagggggcgctctggtcccctgctttacctccctggaaaggggatgccctctcctctaaggaggcagctgaatgagggcgtccagtcccttgctggggggtgggttaaccttacatggatgaggaaggggatagtctggcctatggcaccccagagctggcttcctagcatcagggcagcctggcttaggaggcccctgctacagaagtagtggcatctgtggccagcttggggggctcgcaaggatgcccggcttggaagacaatctcagttgggcatggtttcatctgggaaggccacagacacatcttccactgtgatgctgtccacgatggaggtgagggagtgcaggttgtgggcatctgtagggtcagccgtgagcagatgatcccctgggttggcgctgaactccagtgcactgccccactctggactgcaggaggcgctgtgagagctgcattcgctgggcacccctggctggggcccgcccccgccccggtagcggaggtcacgctcctcctggttgagggagctgagcagggcctggaggcgctcgatgtactggatggcactgcgcaggatctccacctggcagccctgttggggttgagcagggtgcttctcttcagggcctcgaagcctcattcaccttcttgagcctgcgcttctccctcagtgtgccgcccgccgccggtccacggacaccgacttcctcttacacaccttacacgcccacggcaggcactggcctggacagtgctcgggggtccccagccccttgtcctcaaggggccctggggcctcggggctcagggtgagctccgtccgctcgtagcctggtggttcgaagccctggaggtggacaggcaggtagttttccccatcatagaagcggggttcctggtagaagtagggggatgtctcatacagctccatggggtcggaaaaggcttgttcctgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363098 - DNA, 1888 bp, Homo sapiens
cggacgcgtgggtcgacccacgcgtccgcagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363099 - DNA, 1802 bp, Homo sapiens
agaaagaaacgttgggttttattactttccagttactcttttcctcttttctccatcaggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363100 - DNA, 2077 bp, Homo sapiens
cagtgtacagtgtgacttgtgtagtcatacatccccactttaacaaccctcgcttctctcttcatttttgcaccctcctaccccttcccattgtgattcttgttttaatcggtttttctcttcttccttaacagagctattaagaatggcaaaggattgcatagcaagaaggaagtgcctatccaccgtgttgcagatatatctgggcttgagagactgaaaggatttgaaggcccttcgcatctatgtgactgagttctgagagtcgaaatgtccatgatttggcactctggaggatagagcacacagactttgtgttgatgcaccaaaaaaggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363101 - DNA, 2740 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacgtgagtgttggggaccagagtgttggaggggctatcaaacacagcagcccccgagtcaaatccatctgatctctccaaggtccctctgagcttaccaatagaacaatgagcattggggcatctctgctgtgcgtgtaacaggccaggccccctcagtgacctggcaaaactggggtctatgaccagtggctgcaagcactgataggtcccg

SEQ ID NO: 363102 - DNA, 2607 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatgaagaggcggccgccttctcccgagccgagcacgaaggttacagaggaagccgagtcccagcagcagtgggatacttcaaaaggagaacaagtttcccaaatacggtttgccagctgaacagggatcacctaccaggaatttctaccgg

SEQ ID NO: 363103 - DNA, 1545 bp, Homo sapiens
gaggatcccccggaagcacactgcaacaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363104 - DNA, 2273 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcacccattctgtatttaaagcttttgaggcccaataaaatagtacgtgctgtctgcagc

SEQ ID NO: 363105 - DNA, 2237 bp, Homo sapiens
  misc_feature (2093)..(2093): n is a, c, g, or t
  misc_feature (2097)..(2097): n is a, c, g, or t
  misc_feature (2107)..(2107): n is a, c, g, or t
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgcgttggcccaacgttgggccancgcnccgtgttggncctgcgcaccgtgttgggcctggagaggccaccgtgaggcataagctgcatgtcgcgaggccagtgtgaggcaagacctgggcctgtctacgctgctgggagacaggccggaatctggccagggaaggta

SEQ ID NO: 363106 - DNA, 1187 bp, Homo sapiens
tcactgtgctcttcctcgctttcatcggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363107 - DNA, 2247 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363108 - DNA, 2070 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggtgagtcgagtccctgaatcaagctgtgtggctcagaggctcaagagcgtgtctgcatatttgctgaaggacttcagcttatgtattttctctagctcgctccttttcaggcactgactgtgacttttccccaccccggggcatctacttaggtatctatagggagcctgttttattatctggaaaagcagaattaacttcattctttttctttacctgaactgtttctatgttgctttttcatttttaattactgtattttgagtttggaaggtagttcttcttggttgtattaaaataaaattgcctctttttaaa

SEQ ID NO: 363109 - DNA, 1085 bp, Homo sapiens
ttttaatagagatggggtcagcctggtcttgaactcctgggctcaagtgatcctcctgccttggcctcccaaagtgcagcaattataggcatgagccaccacacctggcctaggttgtaattttaaatggggttgcccgagacctcattaagagggagatactttatcacagactgaagcaggtgggagaggtagccaggaggacgtgaccagaggagcgttccaggcagacagaagagctagtgcgaagagttaagggaaaagccaggagactaatgtgattgtgttttccgttttactctgagggaactaaggctccattggacaggcttgagcaagggagagctctggcgcttacctaagcattctgcagggtcctgctggctgatcatttgagggcaactctgaccactccctttcttctctcgtccctccagatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363110 - DNA, 350 bp, Homo sapiens
ctggcaaccagtctttattcattttttaaaaaaggaaatccaaataagttagcaaaaaaaaaaaaaaaaaaaaagctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363111 - DNA, 255 bp, Homo sapiens
gtggaggtgcgcaaggagaaacagttccagaaagtggtatgtgatgtggagaggcggccccagcattgcgccaccaccctcacagagaaagggactgttccacaagccaggaagggagcagggaatccaccatcctgctgttcctgctgaggaaagataatggatttgggtttgttggtgtttttttgtttttgttttaaagctaattacatcccaaattaattggctgcgggtttggctgagaatgcagctgca

SEQ ID NO: 363112 - DNA, 214 bp, Homo sapiens
tgctgggattacaggcatgagccaccgtgcctggccaacctcactagggttctctggggagaaaattacaggcccctgctggccagactttcttgggagtctatggacaggagctggggcccaagtggttgttctctggcttgctctgacctgagtgtgtctctgctccaggatgatgcccgcacggacgccgtggacagcgtagttcgggata

SEQ ID NO: 363113 - DNA, 270 bp, Homo sapiens
tttagtagagatagagtttcaccatattggccagtctggtcttgaactcctaacctcgtgatccacccgcctcggcctcccaaagtgctgggattacaggcatgagccaccacgcctggcctcccagtgtcttttatgacttcacttcctcgccctcttctcacctctgccgactgaacatgcagggtctgggcccactatgaggagcagcccgtggaggaggtgatgccagtgctggaggagaaggagcgatctgctagctacaagccc

SEQ ID NO: 363114 - DNA, 1433 bp, Homo sapiens
gtcctgccagacaagggtgaacccagatgcctgggccagaaccacaggcaggcccggtgaccacagggatacttgttttggtgtgctcccctagccagcagctggagaaccccctggcctgtgggaacgtagtcagggaacccatgtcacagacagaagggcattgggaggaaatggaaaagcgattagagtccagttatactgcgattgttttcatgggaaccactaggtgtgccagcaccaggcccagagtgagctccccatctactgctggaccagcagggcacgttctctccaggcttcacccactggggagcctttgtacattgcaaagtggaaccaagtcatgggatgaacagggtggcccagagttagcattcccagaggcctggccacagagagctgtcctgtgagagagcaagggggcagcgagtatgtgacatgttggcctgctgcttcctctgcagagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363115 - DNA, 1023 bp, Homo sapiens
acacaacctgcattatggtgatacggcctctggaccattcattttctctttcttccccctacgtaggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgaggtaggtgtttcctgaggccatcgtgagcctgtggacctaggtaatagcccactgtcttctgtcgctgatgccattttgatgtactctttctttgtattttgagtatttttatatcatagaactgctgattctggatgtgcccacaagcagcttgtatctgttgtttatatgtttactacctttagtggcagttgaagtcttagagctttttcttgtaccttttcccatagacttagatttgtcgtgttttcactactacttttcttggaatagtttaggaacatttcctgggtagccttaagcatttgaaatcaccattggttatggcagagctcttttattaatttatttttgaattcttcattcatttacattgttcagaatgcagaaggatatatagtgaaaaatcgagtacttcccctgagacacctgaggttactagggtcttgtgtctccttccagagatagttaaaacctgtatgatcagacactctcattttcataaatcgtagcatgctataaatgctaggcccatattttattattttattaaagattgtttttctttaaggttcagagggtacattttcatgtttgttacacgggtatattgtgtaatgttggggattgggcttctagtgtatccatcaccaaaatattgaacattgtatccaatagataatcttttaattctcacccccctcactccttctccccttttggagtccccagtgtctattatttctatctatatgtccatgtgtacccattgtttagttcccacttacaaaagttagaacatgtgat

SEQ ID NO: 363116 - DNA, 3102 bp, Homo sapiens
ttaatcaatacgccgtccacccgcccgtcagggaaggaggagaaggcctaagctgggcccccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363117 - DNA, 3368 bp, Homo sapiens
  misc_feature (62)..(62): n is a, c, g, or t
gcatatctagaggatcccagtcgacggagactctcctagaactctcgctctgccatgtctgnccccgccccccatcctgctggggacccctgaacaagccagcttccttttccaaacacagtgcaaggggcctgggcagctgctcactgctgtgtcctcgtcacatggtgctagcattggcttactgaacataggacggccctctgagacctgatggattatggaggctacagaggggtggctcggcctcagacactcagcacagtccctgccccaggctgctgtgctgagagtctccgtcgaactagttcgacggagactctcgcccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363118 - DNA, 3692 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcaaaaaaaaaaaaaagaataatgaaggagtcccaaaaaattaatagttagaataagaacaaaaaaaaaaacggcgggtttttttgtgggggggacaaagggttttaaaggcgagcagtcgatattgttttctcagcccgtttttaaaggggggagaaggcgggccctcagaggggggaatatgaaccggtatgtagag

SEQ ID NO: 363119 - DNA, 3003 bp, Homo sapiens
agccctgtgcagccccatcgacgacgccggtcctagattgccatcacactcctcgggtaggacgccgcatgtgccgcgatacggccgcagtcaccatcaccgaaaccatgagcggcgagggcgaaacccagcagcacggcacaggcgtgagacgctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363120 - DNA, 3306 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363121 - DNA, 3445 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggtgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363122 - DNA, 3471 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363123 - DNA, 2663 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363124 - DNA, 2169 bp, Homo sapiens
agggcattagagaaggaaaggaagaatggaaacgccacaggcatcctgctggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363125 - DNA, 3068 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaagaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363126 - DNA, 2291 bp, Homo sapiens
gatcgctgtctctctttttctctaagaatccgtttgatgggaagcatgaatcttagttactatgaatactgttttcatcccagcctacctcactgcttctgaatgagaggagcccctttggctgctctgaaaactcttgaaatacttgatggcttgttatgttttcattatctaatgtgcattaatttaaataaaatagctctgttgttagaagaagagtcaaaaaggaaaagcttggctgggtgcagactgcttgtgtcacagaagtcaggaaagtttgcagaacttggtgtcctcagagggagttttcagttctgctggctgggctgaaaacctgaaactctaaaatccagtgactattcccctagcatatacgatgtgatattttgatgctcacttactctatcacctgtttaattagcttgagagactgaaaggatttgaaggcccttcgcatctatgtgactgagttctgagagtcgaaatgtccatgatttggcactctggaggatagagcacacagactttgtgttgatgcaccaaaaaaggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363127 - DNA, 2717 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccggccgagtagagaaagtcgagtctcctgccaaaatagagtgtcctgctaaccctggaataacggcacagagaggtactgcgcatcaccccgtcagggtacctatagctggctcaaactcggggctggaagtcagccaccgaagaggctccgctcatcagggcccaaacagaagtccgaacgaaccgggaagagagccgggaacagaaaccaggccgcacacgggaaccgaggcgggggccggaacccgtggat

SEQ ID NO: 363128 - DNA, 1382 bp, Homo sapiens
cggacgcgtgggtcgacccacgcgtccgctacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgaccgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagc

SEQ ID NO: 363129 - DNA, 2350 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtgataaggcaagtatcctttggcacatagagtttgagacgagaaccactgaagacgtattccaccacagcttcagaacgaccttgcccgctgaagaaaaggcaggaactgctttgctttctgggtatccccagatatatctgaccgactatcgtga

SEQ ID NO: 363130 - DNA, 1638 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaatgcggcccccagaatcacagcagattcagagagactcccagataattttattcttttatttgatgattgga

SEQ ID NO: 363131 - DNA, 850 bp, Homo sapiens
cgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgagtcattctcagcatcttgatatg

SEQ ID NO: 363132 - DNA, 387 bp, Homo sapiens
attggacaggcttgagcaagggagagctctggcgcttacctaagcattctgcagggtcctgctggctgatcatttgagggcaactctgaccactccctttcttctctcgtccctccagatcacagaatacctgaatgcccaagagtcagccaagagcgccagggtgagttcttaccttgggagcccccagagggtaccgagttgaggggtttggccctctgagttccggtgggtcccgtatccctgaagagctattgtctgttttttcttacagctgaacctgtggcgctatggagactttcgagctgatgatgcagacgaatttggctacagccgctaaggaggggatcgggtttggcccccagccccgctcacgccagtccctct

SEQ ID NO: 363133 - DNA, 492 bp, Homo sapiens
ttttaacctgctttttagaaatcagagaattcaaaattgaattaaaatattattattttttttaattttatagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacaggtaaaaatagtgataattctgattacaataaatgagtaacacttcaatacggttcatggtaactggaatagttaagtaaacttattctttaatagctttta

SEQ ID NO: 363134 - DNA, 428 bp, Homo sapiens
atggttgaaactgttgctttattttagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggtaagtttatttatgaggttaaacttttacaaagtttgtacaacagttgaagtacattaacattcctcataggaagtagtctcactgttctgttagtgatctggatttgattttatatacagctctgctatgtgttaggaaagcttattattaatgggaatgtgcgtataactaaagcttccaaaaactttgttttgtgtgtgtcttttttttctttttttttcttttttttttttttttagcaaattctcccacagcc

SEQ ID NO: 363135 - DNA, 1160 bp, Homo sapiens
agctcggcgtggtggcatgtgcctgtaatcccccctacttaggtggctgaggcgggagaatcgcttgaacccaggaggtggagtttgcagtgagccgagatcacgccactgcactgcagtctgggtgacagagtgtgactatgtctcaaaaaaaaaacaaaacaacattgtcatgtctctgatttattttaggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttggtaagcaaaattaaaagttatatagaaatctcactaagattcagataaatttttctacttagcccgcttctccaccaaccttgactggctagaaagggatatgaagtatttgtatattaggaattttcagcattcttttattgcttttaaaatactacttaaaaccaacatgagttgggctatttatggttattgtagacactcatttacagattgttaaattaaactactttactttgtgtgtaaagattggaccccactcgtggcttttcgaaagatgctacttttgaaatatacttgagagagctcagtaaaatatgcttagccactcttcgtggcagatttgctggtatgatgtggaaattacagtggacccttgaaacttgaggatctgacatttatggttgttactattgctaaactactcctggagatatgtgacctttagaaatgtgtaagtttgttgaggtgtgtttttgaattgtattgcttcaaggctggtgttcaggagtatggagctaatgagtcaccttggcttgctgcccagcttttcagcttggctttgcccccatttaatatatgggggtttccttcatgtttataaaaaccctggggagaagatacagctgtcttaattttacaaatgatgaaatggaggagattatgtactatggtaatgtttggaaatttagagatcttaagctcttgggacacataacctg

SEQ ID NO: 363136 - DNA, 4765 bp, Homo sapiens
agggggaagacgaagcttgaaagacttggtaatggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363137 - DNA, 3860 bp, Homo sapiens
agctcggcgtggtggcatgtgcctgtaatcccccctacttaggtggctgaggcgggagaatcgcttgaacccaggaggtggagtttgcagtgagccgagatcacgccactgcactgcagtctgggtgacagagtgtgactatgtctcaaaaaaaaaacaaaacaacattgtcatgtctctgatttattttaggtttgtgtactgcccaaattgcatggcttgacatcatttcttaatgtcgtttttattttaagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363138 - DNA, 3598 bp, Homo sapiens
agggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaacagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363139 - DNA, 3866 bp, Homo sapiens
tattaacaagttcagaatttattagtaaaaagaaatactttaacacagagttgtgtaagtagtagctaaatatttatgtgatctatattatcattatggaaattattgtttatagtctgtataacaggttattaaagtatgtgagtaataagtccatattgcacacataaaatgcctttttcttcattaacttgttaatgtaaaaatatctcagtggcatatggatcactcctaggtgaggtacaaaacactagggggaataagaagcagaaaacacaaaccaaaccatgtttttccagtctgtgaacagaatgttaaatttatgattttcctctctcaaaattaattagctaaaattgaggacttctcttttaactgcagttataatattgttccttgtattagtaatttcctttttatgattttgagtgtgcttatttgcagatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363140 - DNA, 3732 bp, Homo sapiens
agggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagacggagtctcgctgtgtcacccaagctggagtccagtggtacgatctcagctcactgcaacctccgccttccaggttcaaagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363141 - DNA, 3625 bp, Homo sapiens
agggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363142 - DNA, 3765 bp, Homo sapiens
  misc_feature (14)..(14): n is a, c, g, or t
  misc_feature (54)..(54): n is a, c, g, or t
  misc_feature (63)..(63): n is a, c, g, or t
  misc_feature (113)..(113): n is a, c, g, or t
accccggaaaaaanacgcccccttttcaagaaaatttggtaatttccatcattnccttgaccnaaatgactcccaacccacagaaaggcacaaattttcccattgggatttantctgccctcccctttgctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363143 - DNA, 3709 bp, Homo sapiens
ttttaacctgctttttagaaatcagagaattcaaaattgaattaaaatattattattttttttaattttatagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363144 - DNA, 3159 bp, Homo sapiens
aagtataaaaatgctagagacagcatcaacacaacctcttaaaggttgtaacaactgctccaacatgccagtacacctgcacggataaggcaagacatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363145 - DNA, 2140 bp, Homo sapiens
tgggtccgggccccccctcgagtttttttattattgaataattattttttccgtgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363146 - DNA, 2079 bp, Homo sapiens
ggaaatggtttaatggtttccttaaagggtccaaaaatttggccaataaaccctttggacttcctggaaaggaaaaagactttaaaaaggattcaaggttcttccaccgtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363147 - DNA, 4238 bp, Homo sapiens
  misc_feature (4238)..(4238): n is a, c, g, or t
agggggaagacgaagcttgaaagacttggtaatggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaacaaaaacaacaaaacaacaccacaaaacaaacacaaccttgggtgcgggcgccgccctgggcccctggaaaaaggcttcctaaaacactctcggttggggcggcgcgggcgcccagtatggttaagggtgaccgggggccataagcggggttccaaaggaaacacgtggcaggacactggggtggggttcccccccaaataaaaaacgcgcggcggaaccggcggtctgaacaactccagggggtcgggggcatacgggctaccacgggccaggagcgattatagcgcgggggan

SEQ ID NO: 363148 - DNA, 1680 bp, Homo sapiens
acaaatttatttttatttataaatattgtcaactatttaatatttatatttcttttataaaaaatttttttttcaggttatatattcctttatttctttttttttttcacatatataatacaattgtcctcttttttacccccacgccaaatttccaaaatgcctctttttgtagccaaagctacaaacatggcagtgctgtttgttccaacttaaccactctcagtacatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363149 - DNA, 3407 bp, Homo sapiens
agggggaagacgaagcttgaaagacttggtaatggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttacttttttttttttcagaacccaggaccccttcacctttgagtgatcttactccctcgtacatgcacaaatacacactcatgcacacacacactcacacacatgcatacacttaggtttcatgcccattttctatcac

SEQ ID NO: 363150 - DNA, 1167 bp, Homo sapiens
caagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggtaagtttatttatgaggttaaacttttacaaagtttgtacaacagttgaagtacattaacattcctcataggaagtagtctcactgttctgttagtgatctggatttgattttatatacagctctgctatgtgttaggaaagcttattattaatgggaatgtgcgtataactaaagcttccaaaaactttgttttgtgtgtgtcttttttttctttttttttcttttttttttttttttagcaaattctcccacagcc

SEQ ID NO: 363151 - DNA, 728 bp, Homo sapiens
aatagttaagtaaacttattctttaatagcttttattcaactcttaggttgacttttttgtttgtttttgagacggagtctcgctgtgtcacccaagctggagtccagtggtacgatctcagctcactgcaacctccgccttccaggttcaagtgattatcctgcctcagcctctcaagtagctgagactacaggcgcccaccaccatacctggctaattttttgtatttttagtagagacagggtttcaccatgttggccaggctgatctcgaactcctgacctcgtgatccacccaccttggcctcctaaagtgccgtgattacaggcgtgagccactgtgcccggccaggttgactttaaagtaaaaagtttaagtggaatttttagggttatatgtaattattttataatacatagacaattaggttatctaccttagtagtaaggatctaccttttattatttgtgccatagcccaggctgcagtacagcggcgcaactcactgtagcctgtatctcccaggctcaatcctcccacctcagcttcctgaatggctgggattacaggcacatgccaccacacccagttaatttttgtattttttgtagagatagggttgtgccatgttgcccaggctggtctcaaactcctgggttcaagccatctgcctgcctcccaaagtgcaagatctaccttttaaaatcatgttatttatctgttggag

SEQ ID NO: 363152 - DNA, 4922 bp, Homo sapiens
agggggaagacgaagcttgaaagacttggtaatggcgacgggtttggtaagtaggaaagtttcggttgaggagtaagagctgccgcgggagcagtaacccgcgcgggggaggccgacgtcggtcggagagggggtacgagagctgctggtggtgttgtcgtggccggagcggcccgcgcctgggctgccggcacttcgcggcagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363153 - DNA, 3652 bp, Homo sapiens
agggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363154 - DNA, 3959 bp, Homo sapiens
caagcccggagtccgggctgcggtcacatgatggggggaagggaggggaacgcgatgaatggcgaaagagggtgggggatggacttggcgtgaaccgggaggcaccgctctgtgtgacccaaagaggaggcttggcaggcgattccagtctccgcctttcaacctatgctgccaccgcaggccgattgaaacaaaacaaaacaaaccaggcgaagtggacagccaggtttttgtagctttaaatgctgcgtgctgtctagggtgtttcactctccgctgtgcactctacactcgagttcattcttagggagttttcagctacagtcgtttttagaaggagcactgacagcgagtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagggctatggttctgatggtctaaagttgttatcacatgaagaaagtgtatcatttggcgagtctgtactgaagttgacttttgatcctggtacagtagaagatggtttacttaccgtagagtgtaagctggaccaccctttctatgttaaaaataaaggttggtcatcattttatccaagcttgactgtggtacagcatggcattccatgttgtgaagttcatattggcgatgtatgtctacctcctggacaccccgatgccattaattttgatgattcaggtgtttttgatacatttaaaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcaggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363155 - DNA, 4462 bp, Homo sapiens
agggggaagacgaagcttgaaagacttggtaatggcgacgggtttgtcagagcaccataacatggtgtgggaagtgaagacaaatcagatgcctaatgcagtacagaaactcctgttggtgatggacaagagagcctcaggaatgaatgactcattggagttgctgcagtgtaatgagaatttgccatcttcacctggatataactcctgtgatgaacacatggagcttgatgaccttcctgaacttcaggcagttcaaagtgatcctacccaatctggcatgtaccagctgagttcagatgtttcacatcaagaatacccaagatcatcttggaaccaaaatacctcagacataccagaaactacttaccgtgaaaatgaggtggactggctaacagaattggcaaatatcgcgaccagtccacaaagtccactgatgcagtgctcattttacaatagatcatctcctgtacacatcatagccactagcaaaagtttacattcctatgcacgccctccaccagtgtcctcttcttcgaagagtgaaccagccttccctcatcaccattggaaggaggaaacaccagtaagacacgaaagggcaaatagtgagtcagaatctggcattttctgcatgtcctccctgtcagatgatgatgatttgggatggtgcaattcctggccttcaactgtctggcactgttttttgaaaggcacacgactgtgctttcataagggaagcaataaggaatggcaagatgttgaagattttgctagagctgaaggctgtgataatgaggaagatcttcaaatgggcattcacaagctatgacttcacacctatggattcttctgcagtttatgtgttaagtagtatggctcgccagcgtcgtgcatctttgtcttgtggaggacctggtggtcaagactttgcaagatctggattcagtaaaaactgtggctcacctggatcatcacagctctcttccaattctttgtatgctaaagctgtcaaaaaccacagctcagggactgtgagtgccacttctcctaataagtgcaaaagaccaatgaatgccttcatgctttttgccaaaaaatacagagttgaatatactcagatgtatccagggaaagataacagagccataagtgtgatccttggtgacaggtggaagaaaatgaagaatgaagagagaagaatgtacacattagaagcaaaggctttggctgaagaacagaaacgtttaaatcctgactgttggaagaggaaaagaaccaattcagtatgtttcaataaatagtgtttaaaattatcttgccttatccgtgcaggtgtactggcatgttggagcagttgttacaacctttaagaggttgtgttgatgctgtctctagcatttttatacttcaaaacctaataatgttatcacatcatcatataaagactgcctttcctcaagggtcatttactctcatagcatggcaagtcgaaatctcaggcaaacttcaaaagaatgtttgttctaaacattgagttggaaaaataattttggaatgcagtgtttctagttgggttgaaagataagcattattaatccattaatatcacagtagaaaatttctctaataattttgggattgtctcaacagctttttttccttaattggtgagggaccaataaggctggaggtgttggggtatgttagctgtcattcatggggacttgtgccattggcacagaatttctagattgaaaaatttcaaggaggagaagaaataggcccaggaatggtggcaaacaagtctatatgataagctatcttggatagacttgtttcttataacttttccattactaaactagcatcttttaggttcagcgtttttagattaattgcaaaaaaattacatgtgatatagtggggtcaatttgaagtatcattgaaagatgaagggaagatatcaatatttttatagtaggagggctggccaaagatgttttaaattcattgtgtacatgtgcctgtttcttagtaaaatgcaggtcatatctgtttaaatttttcacaatttctttaaaaatagtggtcagtcagtagtcagatgagagggtggctgaactgaattttggcagttcttggttaatttagaatttcatgtgttcggacttttcctgtatcccttttctgttcatcctagtcaatgtcttatcattgcatacattttctggatgcttgagccatcagatatcagctagctttttaaaatcacctttaagaaagcagtattttctaatagtaaatttataaacatcttatacatcttagctttcatatataggattactatgtattgatttgtaaacattcactgagtttaattttatttccacagggctcacaacaacattaaaccaggatgcttatgttcttaagtctatatttgcatatacattgactcttgatggaaagacttaagaagatcaaggtctcaccatttgtcctcaattcgtgtgaccataagatactgatagcattgagtcttgaaatgatttaataatatgagtgaggatttgctttctccattagagcattaagctaaaactatcaacattttaaaccaaattgccttatttttcttccaaacttcatatatgtctatcaggtaataataggcttgaaaattgatatcctgtggtgctaaagtacagtagaaagagaggagaagtgtatacatgttttattttaaattgtacgaaaggggaatttaaaaaatatgtaactgctgtttatacattggctccttactgcttattaatctgtattgtacacatgatgaaatgaagcagaagctgggagtcggcctttcctctagtaaccaccacatggctcagcatctgtgccaaacataggcgctcctagtctggtcagtgccaagaggctaccagaacatggggcaggtggctggtgttggtgtcccagcctaagagccacctgctgcagttaccatggcatgctgagttgatgcaccaggtggcagcagccatccgttattatttccaatggagacctagcccaggccaaggtaaagttagttaatagcattgggatatagtcactgtaatggtgctattaacaaacagtcaacaccattgtattttttaacttcgtgttctgtatctcctcagccatgtatcttaaatatattttgtcatcataatctttatggtgggggcagactttgcacttactgcagtgcaacacttgcactttaattttcctccaactgtctaaaattagagcaaatacattggcaatacagctgcttttgctctgagctacaatcatggcttttcatgttacttaccaagtggtgtttctggttaggaatcacagctgtaaaattgatttcagttcatcacacttcttcatgatgttgcccctaaattttgcacactatattcttgtatattatttcaaataaatggaaaaaaaagttgcttatctctgacgtctactgattgattgattgattgattaatcttggctgaattttatttatgagttctcagaataacaggttcaggagatgagatggaaaacataaggcaaattcctaacactgctaattaggaggctgctgataggattttaaaaattaaaaacaatgttaatagtggaacaagagccatcagaaaataaggacttagattatctactatttatagagaattgctatacaataaaaatttttatttttcacgtggcatttttgttacacggttaaacagcccaaaggtctgcttttaataacatgacaaagtgtaacaaaagccttgctttatttaaagatccagtatgacatacttaaaaaggccatttaaccttgtatcttagcttgggatgtgccagtggttcctcaactttgttgtctattggaatcattttggggatttttttttttttaatagtggtgtctgtcaggctcccactcctagacatgttaattaatgtggagtgcaagttgggcatcaggattttaaaaaaatcccctggtgattggtatgaatgtgcagccaaatttggaaaccactgagctacatgcttatttagtgaagaaggcagggttgggggaagcagggtacatgttataacttgatcatatccctttaaaagaagtggggactttgggtttatgtacccataggaggacttggttatggatgggaaagacattttagccttgtacaaaaatctgaaagaggaaaacatctttctggaaaaatcaggtccatggaattgaaaggtggtgataactcaacattttttatgctaaagtataagtgctaaagaggtaaataaacgtcgataggaaataccgaacaatcaattcattcttaaaatagtagatagtagcagtcttttggagtatgtgtttaactgccaactatgaatgggt

SEQ ID NO: 363156 - DNA, 1966 bp, Homo sapiens
  misc_feature (54)..(54): n is a, c, g, or t
tgaagcctctgtctccagggctcaagcaatcctcctgcctcagcctcccgagtngctgggattccaggcatgtgccaccatgcgcagctaacttttttctatattttttgcagatacgggcttctgccatgtcgcccaggctggtctcagactcctggactcaagccatccacctgccttggcctcccaaagtgttgggattacaggcatgagccaccacgcctggcctaaaaacttttatctgtgaattttctatttcttcctcccactgggttttcatctctagccagtcactatatttgacttgctgatttgtattttctttttaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggtaagtttttgacagagtgggggctaggagagttgcctttcccagtaaggtgcccactttatttggagatcttcttgcagaactccccgaggacttgtgacttctccatgtattctgggtgtccagaagatagggctgtgtaaggaatggccctctccagaggtgggaaagacctcacagctgagagtggcaggataaccatgtgaggacttgtgggtatctagtaactcttcctcatgtctaggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363157 - DNA, 975 bp, Homo sapiens
  misc_feature (521)..(521): n is a, c, g, or t
agcagtggtatcaactcagagtggctattacggccggggggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcaaaaaaaaaaaaaaaaaaaaaaaaaagttttgtgggggggcctggggccccaggaagaaggtttttaaaaacccccttctgtgggggcgggggggccccaattgtggtgttaggtacacacgtgtggccaaagggggtgttcccaggggaaaacccgggggcaagggaacaatggtgtggggtgggttctctccccaataaaaaaaaggcccggggggaacccccgggaggggttttgtggacaacaccccaaatagcgcagggtcggggggggccagatcgaaggcgctctactcacaaaggcacgctctaaaggcgggcctagaatataaattcagccngcgcgggagggtagaaaacaagagtaaatatatgaacacgaggaagaactcacatagtgctaataaggagtatgcataatgatataaagactatatataagcaacatgacgaatgatagagtaatacatagatgaaggagatacaaaatgcacgaacagacagagagagaagtgatactaagccgacacaatgagcggagatgaagaggaaaagagatgaaatgacgagaacaaagcgagagaaagacagtgcaaagcatagggaagagataatgagcgacaaggatgcgagagcgactgaacggccggagacacagagaagagaacgcacgagaaagacggaagagcgaacggagacagacgagaaccagaaccggagtatccacgcgacaacaaaagagaaacggagacacaccaacacaaacaacaacttgagatgaaagcacggactacg

SEQ ID NO: 363158 - DNA, 303 bp, Homo sapiens
atacaagggggaattcacagggcctaccatctctgtatcaggttgggcactgcttatactgctggccccagggatggtgcccaggctgagcagaaggttgaggggtggcatcatctcgggatgcagatgatccactcccttttctgtgcttcaccagggtttgtggatgacatcatccaaccttcttccacacgtgcccgaatctgctgtgacctggatgtcttggccagcaagaaggtacaacgtctgaatttttttttggtttgttgggtaggtagggttgtgtgaagtatctataagcgg

SEQ ID NO: 363159 - DNA, 3048 bp, Homo sapiens
  misc_feature (2594)..(2594): n is a, c, g, or t
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctcttttgtgccttactgtaaaattatttacttttttaaacattttaagttgtattttttgagcataaattcgatttttttaggtggaaatctgaaaaatcaatacaactagaaagaaaaatagtacacagtgttatcatctagagctgatttttatttcacacctctgggtattgttctttttcctctcgagttagtttttttatccataggtgagatatatagtaagtttttaaggcaaagtatttcttaggcttaagtttccttattttaaaaatagggtaatatgccctatctatctcctaattcctccatgaattgaggattacaatgtgatgtttgcaattgtggtatatgtgtttagcagtacagatgctcaataaggcatagcaccctatgttgactcaggttatttccagaaaaaaaaaaaaaaaaaaaaaaaaaaaagttttgtgggggggcctggggccccaggaagaaggtttttaaaaacccccttctgtgggggcgggggggccccaattgtggtgttaggtacacacgtgtggccaaagggggtgttcccaggggaaaacccgggggcaagggaacaatggtgtggggtgggttctctccccaataaaaaaaaggcccggggggaacccccgggaggggttttgtggacaacaccccaaatagcgcagggtcggggggggccagatcgaaggcgctctactcacaaaggcacgctctaaaggcgggcctagaatataaattcagccngcgcgggagggtagaaaacaagagtaaatatatgaacacgaggaagaactcacatagtgctaataaggagtatgcataatgatataaagactatatataagcaacatgacgaatgatagagtaatacatagatgaaggagatacaaaatgcacgaacagacagagagagaagtgatactaagccgacacaatgagcggagatgaagaggaaaagagatgaaatgacgagaacaaagcgagagaaagacagtgcaaagcatagggaagagataatgagcgacaaggatgcgagagcgactgaacggccggagacacagagaagagaacgcacgagaaagacggaagagcgaacggagacagacgagaaccagaaccggagtatccacgcgacaacaaaagagaaacggagacacaccaacacaaacaacaacttgagatgaaagcacggactacg

SEQ ID NO: 363160 - DNA, 2079 bp, Homo sapiens
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggtaagtttttgacagagtgggggctaggagagttgcctttcccagtaaggtgcccactttatttggagatcttcttgcagaactccccgaggacttgtgacttctccatgtattctgggtgtccagaagatagggctgtgtaaggaatggccctctccagaggtgggaaagacctcacagctgagagtggcaggataaccatgtgaggacttgtgggtatctagtaactcttcctcatgtctaggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363161 - DNA, 1811 bp, Homo sapiens
tggagctaaccggaaagaggccccctgcgcgggtgtttttaacactcggcacgaggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363162 - DNA, 1891 bp, Homo sapiens
agcagtggtatcaactcagagtggctattacggccggggggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcagcaaataataggctgggcacagtggctcccgcttgtcatctcagcactttgggaggccgaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363163 - DNA, 1337 bp, Homo sapiens
cgtccctgctcctggcttttggcctgctctgcctgccctggcttcaagagggcagtgccttcccaaccattcccttatccaggctttttgacaacgctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363164 - DNA, 1344 bp, Homo sapiens
tggggggtagcgtgagaggaggggatggaggatctgtcaggagcacatgcccaaaagatctgatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363165 - DNA, 614 bp, Homo sapiens
ggggctccagtgattgggctgaatgactctgggggagcacggatccaagaaggagtggagtctttggctggctatgcagacatctttctggtgagaaacctgttaatagagaataaaaaaatacagggcttaagttctctaagccatggcctggccagagcttctccaactctcctcattgttctctgccgcattgtgtctgttctgtgggtcctttctgtgtcactgggggtgggatgaagggtagatgaaaagcaagagagagtgggaagagagggttttcattttttctaacagagggccactcacaggggaaattacagttaaagatcgttcataagggaaaagcacttgaaaatgtttttctttttttgaaagcaagggagaggaaatatgaaaagttaaaatgaactgatgtgcttgaattagaagttttaaaaaatgtagcaccttttttattttttagttaaaacactacaggattattaaataaagtccaagccacagtgcaaagaagaatgaaatcaccccagatcctaccattcagaaacatttggcgaacctcattactgatatctctttgcttatttacagactgaaattatgagagaaag

SEQ ID NO: 363166 - DNA, 1835 bp, Homo sapiens
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363167 - DNA, 1831 bp, Homo sapiens
agcagtggtatcaactcagagtggctattacggccggggggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363168 - DNA, 1734 bp, Homo sapiens
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363169 - DNA, 1681 bp, Homo sapiens
cggacgcgtgggtcgacggacgcgtgggtcctcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttgaaaatgatgttgatgccttgtgtaatctccgggatttcttcaactacctgcccctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363170 - DNA, 1781 bp, Homo sapiens
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgaggaaagctaacagccagggagaggatcagtctcttgctggaccctggcagctttgttgagagcgacatgtttgtggaacacagatgtgcagattttggaatggctgctgataagaataagtttcctggagacagcgtggtcactggacgaggccgaatcaatggaagattggtttatgtcttcagtcaggattttacagtttttggaggcagtctgtcaggagcacatgcccaaaagatctgcaaaatcatggaccaggccataacggtgggggctccagtgattgggctgaatgactctgggggagcacggatccaagaaggagtggagtctttggctggctatgcagacatctttctgaggaatgttacggcatccggagtcatccctcagatttctctgatcatgggcccatgtgctggtggggccgtctactccccagccctaacagacttcacgttcatggtaaaggacacctcctacctgttcatcactggccctgatgttgtgaagtctgtcaccaatgaggatgttacccaggaggagctcggtggtgccaagacccacaccaccatgtcaggtgtggcccacagagcttttctgagcagtcaggacccggctcccgtccgtgagtgccacgatcccagtgaccgtctggttcctgagcttgacacaattgtccctttggaatcaaccaaagcctacaacatggtggacatcatacactctgttgttgatgagcgtgaattttttgagatcatgcccaattatgccaagaacatcattgttggttttgcaagaatgaatgggaggactgttggaattgttggcaaccaacctaaggtggcctcaggatgcttggatattaattcatctgtgaaaggggctcgttttgtcagattctgtgatgcattcaatattccactcatcacttttgttgatgtccctggctttctacctggcacagcacaggaatacgggggcatcatccggcatggtgccaagcttctctacgcatttgctgaggcaactgtacccaaagtcacagtcatcaccaggaaggcctatggaggtgcctatgatgtcatgagctctaagcacctttgtggtgataccaactatgcctggcccaccgcagagattgcagtcatgggagcaaagggcgctgtggagatcatcttcaaagggcatgagaatgtggaagctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 363171 - DNA, 380 bp, Homo sapiens
agtaagaaatcagcatgctattaatatatcagctcctgaaaattattttgaaatttcagaggtttatgaaatccaaaggtccaggagcaactatatgacaggctaggaaattactaggacactgaagttcttagctctcagcgctaacgctggagatgagtctatactcatctcttgtctcccagacgactagtagagtagagtaactggaacatagaaaccttggtttttgtttttaaagagatgaatacacaagtgaaaaaagcttttaaattttagaaaatgcatttgtaagcttgtagccaaagattttccatgattttttaaatcatagaaagttctcagtgggacctcaaaagcatccctaaattagcgggctt

SEQ ID NO: 363172 - DNA, 3557 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacaggtaatttttttttaagtagacaagttattgttaagccttgaataatatctggttattatttttcttttaaaaatgtaattggtttatctgaaatatatttatattttatgagctttgaagataggtcagtagagtctttagtaatataaaaacctctgtagttacgtgagttttcttttagattaaatatttctttaaaatgcaaactcattgtggtattaaaaccttgtaaataagtacattatcattcttatctttacgtaagaggtgttgagaaatgtaatagagagtggttgcatagtatttgcctagagtcagctttgtatattttaaaactgaataaaaactgaacataatgagctctaattttataaagccttcctactaaaaaatgatcttaagtctcttttttctagttctttaatctgtttcaaggtgagaacttggagaacctatgggaacaaatgttttaaatatctccctttaggtggttgtttataggatctggatggcagacaaatcaggactgaatttctggaaaattccctaagtgtgtttgctctgtattgattgaggaaggatttgtgtctgttaggaactggacatctaggttgcaggttgataatccattctaaaaattctggagcatgatttgtatttttgctgagggaggctgctaatttgtatctagatggagttggctatggaaaagcttgtgaactgggatgtgattcactaatagtctttggatctgctcagatgcttggacaggagcttgggtgagatctcagaattctgtggcaaaggtaattttggtctagaaaaatgttgagggcaagtagtatcaattggttacttaagccacaaaaaaacctaagactcctacagaatgtctaatattgagatgctatataatgtagtatatggcccctaaatagctgaatagaagacccttttgaatagatgtaaaattgttcattttaatgttgaagagtgtttctcagaaacaatttttattttgacataatgttatctttttctgactgtaatttaccaataggtttaacgattttaaataactcctggtttcttatgctatgattagaacagaaaaatgtacatgtagcatttctatggcagaatatatatcctttctctaatttaaatttaagctaaagcagggagagtgtcaaagcaacaaccttgttttacattatttaaaatgtgaattttgcccaagaacattccttcttagatctgcaattcatgtacattcatgtggcttggccatagtaattttttttttttttttgagacagggtctcgcactgtcacccaggcctggagtgcagtggcgcgatctcggctcaccacaagctctgcctcccgggttcacaccattctcctgcctaggcctcccaagtagctgggactactggcgcctgccaccatgcccagctaattttttttgtatttttagtacagacggggtttcaccatgttagccaggatggtctcaatctcctgacctcatgatccgcccgcctcggcctcccaaagtgctaggattacaggtgtgagccaccgcgcccggccaactcatagtaatttttttaatcctcaaaaatcaactgataagaaatcagtaaaaaaataaattttaaaaattgccaaaaagattagacttgttttctttatttttagataaggaaaattaggtttatggaagttaaataatttattctgtagtactcaattgctagagcaggaattcagtgtccagtaagtaccatactcaccatgtctaatttcaaaactctccacggcacgatgcatgtgcagtgctctcagatattccatgggtttgcacttgttatgaatataaattataacccccatagattatgttttctatagttgatgctttggccattgtcattcctgtttggctggactaagatttagcatccagaatacgtaaagatcagaccgttcctaagatgacacggactctgaggaatctgcatctcaacagaagaaatccacattaaggccataaccacaggatgccctggtcaggtatctcaaaccatcattcccatcctaactgatcagaatggttggctcttctaacctgttcctttgaaagattataaaatggaataacaaaagattctttcatttacaagcataatttaataaacctgaatctgcttcctaatctaactttctttttaaaaaaaatagaggcaggggtggacacagtggttcacgcctgtggtcccaacaccttgggaggctgagacgggtcagtcgcttgagtccaggagttcaagaccagcctgggaaatgtagggaaaccttgtctctacaaaaaattagccaggtgtgttggcacacacctgtggtcccagctactctggtgtctgaggcaggaggatcgcttgagcctgggaggtcgagacttcagtgagctgtgattgtgccactgtactccagcctgggcagcagagtgagatcctgtatcaacaactacaaaaagtgttccctgagttcaagtcccttaaatttattttgcacctcattttaaaggggggttgagagtcctgagctaaagtggtgagcaaagcccccattattgcccagccattcctcctctaagaggttcacgcccttggccaaagtcctcaaaacctggagcatctcagccccagctccgcattggaatcaccttgagagctttaaaaatttctggtgacaggtactttcctaagggcattacaggaacgaactcacctgggcctcaccagcaactgatggcatggtacccaagggtcccattgtacaggtggtgggatgtggtggggacaggggccaggtgtaccgcaggcagggagatggtggctgagctggggtaaaaaatgcatgcctgtccccacagggccagtggacccccatgtcctgaccttggaggtccagagagcacatcagaacttggccagcatacggagctccacagctgactgaccacacagttcatagagacagggtctcactctattgcccaggctggtttgcagtggcgcaatgacagctcactgcaaccttgacctcccgggcccaagtgaacctctcgcctcagactccagagtagctgggactacaggcacatgccaccatacccatccaattttttgtattttttatagagacagaggtctatgttgcccaggctggccttgaattcctggcctcaagccatcttctcgccttggtctcccaaagtgctgggattacagatgtgagtcaccatgctcggcctaacttttttttttttgagatggggtctcgctctgtcacccaggctggagcgcggtggcgcagtctcggctcactgcaagctctgcctcctgggttc

SEQ ID NO: 363173 - DNA, 552 bp, Homo sapiens
tctcatgttatcataattgcaagaaagatctgaaagaagcgagtggtctgagcctgccctgcttgggtctgttttgcaaagaagaggagggtggggaggggagctgcagtaagagccttaaaaagatgtctcagaaactggcacatcatgatctagacgagggcccacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363174 - DNA, 485 bp, Homo sapiens
cgcggccgccggcctcctaggagcgctgcacctggtgatgaccctcgtagtggctgcggcgcgggccgagaaggaaggtgggtgtcccccggcggcgtccctgcggcggggctgtcaccccgctctcgcggaggccgggagggctgggccgggaggaagggccgcggccggggctccggcgcaaagttgggcggtcgggtaccgtcccgagccgggacctcgcggcgcccgccgcacggagtggccttcgctctccgtgattccttcccgtgccttcccccgtctcctgtcactgccatttcaaaacttcctgacttctcgtacgttcttgccacttggcccgctaggtaggaggggcatattttttggctttattgcggcgaataggtacattttaggacacttctgttttcttggttgcggttggttgcatgcagacagagcttactttaaaatgtggtaaaaatagcgagacacagcttaaa

SEQ ID NO: 363175 - DNA, 215 bp, Homo sapiens
gggcagtacggatgtgaaaccttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgcccgcccatccgtacgggcccggggtaccgagctcg

SEQ ID NO: 363176 - DNA, 6127 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatatttgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363177 - DNA, 2903 bp, Homo sapiens
acgaagggtgatctgtgcacgaagggtgatctgtgcacgaagggtgatctgtgcacgaagtggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363178 - DNA, 1982 bp, Homo sapiens
attcctcttccaactgcaatgacaagtggaatctcgctgggagatttctacgtgcttactttccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363179 - DNA, 5622 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgactattaaactcgttccagctcctctgtgagccctgagtgcacg

SEQ ID NO: 363180 - DNA, 1817 bp, Homo sapiens
caaaagtgtgatcgaagcctctgccagtccctaaattgtgatccctgccctggtctctttcatagtgatcttttgttttcttacctttctccagaaagccctctatctctgtctgattaagcagtctgaggccccagagcatgtgacatgaggctgagcgatgctctgtgagctgccccgctgcagagaagcccactcagggctcagtcctgccagccccacacctccccgagacagggcactgctgatgaggaatgagttctctctttgcttctttttcaagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363181 - DNA, 964 bp, Homo sapiens
cacggcagtgaccgtatcatggtccagctgttccgtgtgttaaaatgaagtgggctagggcatttgtaatcttagagctgaatcctatcatcactgcgcccgctcataaggggatggccatggctaggtttatagattgttgggtggttggtgtaaatgagtgaggcaggagtccgaggaggttagtttgtggcaataaaaatgattaaggatactagtatccttaatctctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363182 - DNA, 4473 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaaggtaatcatctcccactgccggagatccgtgatgtgtgagggaaaagccagtgcgtgcttaaggagctattaagattatagttgtggtaaacaactaattcagtaggttcctctggctcagatttatctccagtgttggacttcaacttttccataaaaatgcaattagaggtatctgtcataaaagatatatttgtatttcttagattgtttaccaaaatcagaaattctgtggacatctgcttttcttttcagctgcctgagattgtgttattgtgatagatttagcttttgttttattgttaaaataattttgagcacaggagtaaaatggagatcatctgccttttaactccaaattaggatttctttactttagagcaggggttggcagactacagttagcgggccaaatcaccacctggttttataaataaagt

SEQ ID NO: 363183 - DNA, 362 bp, Homo sapiens
attttccaggtccccaggcagcggcctcagctgtccacccctggaggatgtggaagaccctcctcccctacctgaggtgggagaagtgaagacattgactgtccgccacacaacacagcagggaccgggcacgctcttgctcccctcaaatccccgagtgcagagagatgtggctgctttctctttaaaacctgttaaacagaacacatctaagagctttcgtttgttttctttgtagaagggcttgagttatgcatagtcttagagaacattcaaagtgatttggaagagcgctaatcaaaacaccacactaacgagcccgtttgtttttaatttccagctactgatagtctttataaact

SEQ ID NO: 363184 - DNA, 649 bp, Homo sapiens
tgaataaatatgtgtacattttttgttttaggtttaacttgagtaaggtggcaaagatagatttgagaacactagaatttcaagtcttcagaaacagtgtaagtattcaaacttcatactattccaaagaaattattttataatatgatcaatataaatatgaaagaaaattattggctactcttaaatttggctgaagggtaagttactgaagaagtcagagcagtccagtaattatttcagaggcaaaataaatcaggaagagtaggtgggatttagatcaaggtgaggcacattgagtaaaaggttcgtatttatgggcattaaacattaagcccatgaaggtttgtaataataattacagaaattctgagaatatatagatgaggtaaatattaatacatcattgatttttattaagcatcaaaatattgagctcagtcatttacattttcattctggatactttgtaattaaattgtaagccatccatgaatgctaaacccatgactggctgtgtttgtatttagcatggtaatatgcatgattttcactcaatggataatcttttatttataaacatatacataaactggtttgttctaggaaccaaactattttctattatttaggccaggctgagcaacca

SEQ ID NO: 363185 - DNA, 201 bp, Homo sapiens
gtcattttattaatccttctcagcaattaagtgtccattttttacaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccaggtgagagaaataagtgtacagagaaa

SEQ ID NO: 363186 - DNA, 6313 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363187 - DNA, 6196 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaatagggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363188 - DNA, 6044 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagctgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363189 - DNA, 1137 bp, Homo sapiens
cttttctgtagccttacccccttacccacttgaccctctgcctgccgggctcagtgctggacgctttctgttttgtcgcagtcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttcaaaaaaaaaaat

SEQ ID NO: 363190 - DNA, 3545 bp, Homo sapiens
cgcggccgccggcctcctaggagcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaagtatgttcacatgctggcaataaattccctagtgtacatagatttggctgataaaattacaataaaaaataagtttcttttcatctttgctcaggagaaaaaaaaaaaat

SEQ ID NO: 363191 - DNA, 343 bp, Homo sapiens
gtttagagtgagccagaattgggatgttttggcatgttttgttctgggaaactgaggatagaaggtaggatgtgttataccctcccttattatttactgaaccttagtagaaaatgaaggaaagaagtttttggtatacagatatgtatagataagcttttcaggcacttagatttggggttttgttttaaagcatattgtaaatgatattgctgtctgagttctggactctttttatctatgtttaactttttaaaactggtctttgtattagtttgctagggctgccataacaaagtatcatacactggggtggctgaaacaacaaaaatgtgttttctca

SEQ ID NO: 363192 - DNA, 404 bp, Homo sapiens
gcccagtagagagaggttttggagctcacctgcctcaggttcaaatcctggccctgctattccctgggtgtgtgagtgtggacaagtcttctcatcctcagctataaaatgggggtgctgggccaggtgcggtggctctcgcctgtaatcccagcactttgggaggccaaggcaggtggatcacctgaggtcaggagttcaagaccagcctggccaacacggtgaaaccctgtctctactaaaaatacaaaaatgagccgggtatgatggcaggcacctgtaatcccagctactctggaggctgaggcaggagaatcacttgatcccgggaggtgaaggttgcagtgagcggagattgcaccactgcactctagcctgggcgacagagcaagactccgtctcaa

SEQ ID NO: 363193 - DNA, 288 bp, Homo sapiens
tgaaactatctgggaaggtggtattcctacgcagacagaactggtttatattgcttacaacatcggtggtgggaacggaagacagcttgccttgtctcgcttcagtgtggggttcctctacccttaagaatttctgaccaggtaaactatctctccattcctgtgagttcagacctgtctcacaaacttgtgacaaaagaagtctgaggacttgggaatgaatctagattccttgctccctccattagcccccttctccctgtaaatatatgtgtcagtaatgtgata

SEQ ID NO: 363194 - DNA, 1073 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363195 - DNA, 1704 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctggtacggcaatgggcacaggcatccggaatattgctgcgacgccaaggccagccgtgggggtcgggcgggggaggcatcggccgcacagagccatgtaccagactcgggggactcttaacgtatctcccgctacccccactcggttcctgtcattcgggctccgttatgaggggccacaaccagagaaggtgcggcgaaggccgaaccacgccatgtttctcctgacttcgtaatctcctagccctgttaacgaaaaaagacacgctggacgatccatcccggctaggggtggtacggtgttgaccggaaatccccagagttgccgccagtggtttttcccaggtcgcctttgtcagtggggggcggggcacggatgaacctgttgagggccggcggggacggtggatgcttcccgcggtcgctcttggtttttcccagttgtgccggattgaaaaggggcggggcatggttggacgggctcaccgtcggagaaggggtgcgacgcggtcctgctttgctgacagtctgtcttggctagttaacacgcctatgtcgcttattgaaacgtcaactctgcgtgtgccaattcatttaatctttgatcacagtaaaaccgttggctgattccttgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363196 - DNA, 1223 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgtttgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363197 - DNA, 1480 bp, Homo sapiens
gcgattctcctgcctcagcctcctgagtagctgggactacaggtatttatttatttggtagagacggggtttcaacgtgttgcttaggctggtctcgaactcctgaactcaagtgatccacacacctcggcctcccacagtgctgggattacaggtgttagccactgcgcattttacctagaggcagattctggctcagaaacccggatagaggaaaatgacaggaatttaattggcagacggaagacagccttgaagttgagagaattcttttaacataattctttttctctgaccacctcccctcccagaagatcgcaaatgccatgactttaaatgccatctattagccaaggtctctgcaatttatatatgtagccccgtccctcccctagactcctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363198 - DNA, 463 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttgtgagtccaggccttccctgggttggtgtggggttagctatcttgcccacaagggaggctgctctgaaaactgcttggagctgccagtcacgtgcacttattcattctggtgcccactcacctactatgtgccgagcctggctcctgtatctgggattttgtagggattgcaaacatggcctctgtct

SEQ ID NO: 363199 - DNA, 581 bp, Homo sapiens
tcgattggccaatgagagtgcgtccttggcgtgacatgcggtatagcgacccaatcgctgcccggtaataggcggaaagctccgacgccggtgtgcgtctacgctgggggcgtggcctgactgcgcggccagacgccagcgccatggaggagtacgctcgggagccctggtacggcaatgggcacaggcatccggaatattgctgcgacgccaaggccagccgtgggggtcgggcgggggaggcatcggccgcacagagccatgtaccagactcgggggactcttaacgtatctcccgctacccccactcggttcctgtcattcgggctccgttatgaggggccacaaccagagaaggtgcggcgaaggccgaaccacgccatgtttctcctgacttcgtaatctcctagccctgttaacgaaaaaagacacgctggacgatccatcccggctaggggtggtacggtgttgaccggaaatccccagagttgccgccagtggtttttcccaggtcgcctttgtcagtggggggcggggcacggatgaacctgttgagggccggcggggacggtggatgcttc

SEQ ID NO: 363200 - DNA, 968 bp, Homo sapiens
ccatatacggcagtagctcggtcaactcggacgagggcagcgccatggaggagtacgctcgggagccctgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363201 - DNA, 1176 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363202 - DNA, 1411 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctggtacggcaatgggcacaggcatccggaatattgctgcgacgccaaggccagccgtgggggtcgggcgggggaggcatcggccgcacagagccatgtaccagactcgggggactcttaacgtatctcccgctacccccactcggttcctgtcattcgggctccgttatgaggggccacaaccagagaagcccatggcgaattgtggatgattgcggtggagccttcactatgggtgtcatcggtggcggagtcttccaggccatcaagggtttccgcaatgcccctgtttgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363203 - DNA, 1694 bp, Homo sapiens
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttagacggggtttcaacgtgttgcttaggctggtctcgaactcctgaactcaagtgatccacacacctcggcctcccacagtgctgggattacaggtgttagccactgcgcattttacctagaggcagattctggctcagaaacccggatagaggaaaatgacaggaatttaattggcagacggaagacagccttgaagttgagagaattcttttaacataattctttttctctgaccacctcccctcccagaagatcgcaaatgccatgactttaaatgccatctattagccaaggtctctgcaatttatatatgtagccccgtccctcccctagactcctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccattgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaaaaaaaaaagcgggggctttttggggggcgaaaacggttataaaggcctggtcatttttccggccatttgtaaggggaatccgcggcccatggggaatgaacgcagctaaaag

SEQ ID NO: 363204 - DNA, 349 bp, Homo sapiens
ttttttttgagacaaggtcttgtgctgcccaggctggagggcagtggtgcaatcatggctcactgcagcctcgacctcctaggctcaaagcaatcctcccacttcagcctcccaagtagctgggactacaggtgtgtgctaccacacccaactaatttttgtattttttgtagagatgggggtctcaatatgttgcacaggctggtctcaaactcctgggctcaagtgatccttccacctcagtctcccctaaattgttaggtttacaggcatgagccaccacaccaagcctagaatggaattcttaaaacttaactgtatacagactttcacaactcaaagaaaaaaa

SEQ ID NO: 363205 - DNA, 416 bp, Homo sapiens
aaagaacagtgggccagacatggtggctcacacctgtaattccagcactttgggagggtaagggggacggatcacttgagaacaggagttccagaccagcctggtcagcatgccgaaaccctgtctctactaaaaatacaaacaacaacaacaaaaaatcagcaggatatggtggcacatgcctgtattcccagctactctggaagtcgaagcacaagaatgtcctgaacccaggaggtagaggatgcagtaagccgagatcatgccactgcactccagcttgggtgacagagcgagactctgtcttgaaaacaaaaacaaacaaataaaaaaagaacagtcatcagtcaactcttaggatgcattatttcaacttcttacaccatagcattttgtgcagcttaacaaagtgaact

SEQ ID NO: 363206 - DNA, 222 bp, Homo sapiens
atttgctgaatgatagaattagaaaaattaccatttgagaatcatcatagtaatatttaattcagctaaggaacatcaaaggatgctaacattagtctgggcacagtggctcacacctgtaatcccaacactttgggaggctgaggtgggaggactgcttgaggccaagagtttgagatcaacctgggcaacataatgagaccccatccctccaaaaaaaaa

SEQ ID NO: 363207 - DNA, 657 bp, Homo sapiens
atagctcgtaccctgcgtctttctactgcggttgtcatcttgatagtggcccgtttcattcatgtgcacagtcagctcgactagggtgtcataggccgcgctgcactgtcggcatcggaatctgctggcccctgtgaacacagtcccgcacatcttgctgctctgtcggtacaactgcaccgagctgaacaggctgggtttcgagacggaccgagaaggcaagttctgctgcaggcttttggacagagcgtcttggtgccaatcaaaatcactcttgttgctgccgtttcgggtgtcacagttcctcctctcactattggacagcttgaagccaaggcccaggcctgaccagtaggaatccgacaggatgttggcgtagacagcggtcattttatccatgcaattgtgtgcttcgtttggaagcctgacgtgagtgtgtgctttcttgtctgaggcatctctgccgcagacactcttgatgtccgacacctgatcactggcgtcactcagcagagactcgttctcggcatcctgattggacaaatgacttcctggagagttctggtagctgaagcagcctttttgctctgggcccgtttctagctcctcgtccgtccctgtgtcattgccaccctgcagttgagctaactgaaccgc

SEQ ID NO: 363208 - DNA, 376 bp, Homo sapiens
gtaggaatccgacaggatgttggcgtagacagcggtcattttatccatgcaattgtgtgcttcgtttggaagcctgacgtgagtgtgtgctttcttgtctgaggcatctctgccgcagacactcttgatgtccgacacctgatcactggcgtcactcagcagagactcgttctcggcatcctgattggacaaatgacttcctggagagttctggtagctgaagcagcctttttgctctgggcccgtttctagctcctcgtccgtccctgtgtcattgccaccctgcagttgagctaactgaaccgctgtcctcctcctcctcctcttcttttatttcctcctcttctttcagctgttcctcctgggcgtagcctgc

SEQ ID NO: 363209 - DNA, 342 bp, Homo sapiens
gttcatcagctatcactagtgatagtgtattttatgtgtggcccaagatcacattcttccaatgtggtccagggaagccaaaagactggacaaccctgatttagagtgagtgagacagtgcaaaggaccttctacaatgaaccaaggtaggcagaaatgaaagcaagtggagcaggtgcccacctggaaactggccatcaacacagggtagcaataagaagagggtgaaaaatcactaatgtcagctgtcagtgagactacaaaaagcacccctagggctctaatccaataggcaacagtagtaacattataaaatttatctttaaaagattgatctgacag

SEQ ID NO: 363210 - DNA, 2118 bp, Homo sapiens
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363211 - DNA, 2466 bp, Homo sapiens
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363212 - DNA, 907 bp, Homo sapiens
  misc_feature (334)..(334): n is a, c, g, or t
  misc_feature (338)..(338): n is a, c, g, or t
  misc_feature (857)..(857): n is a, c, g, or t
gtctgtctgtttctgttgttgtcttctttctcttgttctttttttggttgtctgttagtttttgtttctatttgtttgtcttgttctgtctatttcgcttgttgttgcgtgtttatgtgtcttgtgctgttttcttgttgtgttctgtgttttcgcgcggcttgtgtagttgttttggctaattagccgggtcgatatttgtcatagcatgcatatttgtagtgtgggttaaacacagcattagccgcttggtgttattttttgctccgcgagcgttattattcgttctgggtgttttggcgccatcatatggtgtcccccgcgctcgttttgngggntttgctttccggactaggtgatccctcggttgaccgtttttgttcctcgccttcagccggtgtttgtgtttatgttggctcctgtttccgctgttttttttattcggcctcctttttgggggccgccctttgttaaacaaaaattgggggtgtggtgatattgggtccccccctgggtgattttttgttggtgcgccgccccccttttttttttttttgtgtttgttttgtttgtggttgtttttttttttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatganaaaaaaaaataagggcggcggctcgcgatctggaattagcccacgcgtcc

SEQ ID NO: 363213 - DNA, 427 bp, Homo sapiens
ggctctagagatcccctctgtgtggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgtcaactgctgtgaatgctgtatggtgtgtgtactcttctgttactgatatgtaagtctggcaatgt

SEQ ID NO: 363214 - DNA, 2463 bp, Homo sapiens
  misc_feature (2)..(3): n is a, c, g, or t
  misc_feature (5)..(5): n is a, c, g, or t
  misc_feature (61)..(61): n is a, c, g, or t
gnngngggggcggatgaggagggggcgcagctcttagggagggtggcacaagaccggcgtntgtgttccgggcgacggggatggtggtgtccgtcaggccccccgggagctggggtcgtccaggattctactgaggccccgtaggactggtgacatccttaaaaataagggggaaattggggggaagagagtcctgaggaacactaatgggcagagtacagtggcacgatcttggctcactgcaacctccgcctcctgggttcaagtgattcttctgtctcagcctcccgagtacctgggactacagctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363215 - DNA, 2861 bp, Homo sapiens
tgagggtctgcattcaggaagaggctgcctaacgctaaacaactgggttgtttgtttgccataggcccagggaagaataggaggtggagaaagtctaatcgaacccaggatagaatcctgtgtgagagagaaatttgctactctttcagttgaaatttgaactctgaatcccaagagaaggcaccagtaggtcatttaatacttcttgttgaggcttgcaaaagacactgcatttctaacaaagcgtttgcccatccaaaagagagatcctgatttggcatataaaactactgcctcttctggttatctttcatcacttgcctgagtttaaaaaggtaataaatggtttgtgttctaagggaaagaggctcttcccaagacctgaggctttctcattcctaccagctgggcccattgctaaaatgctttccagtgggcttgcttctgcctggccagcacctgggctgccccagcttgtaattagcctgcctttgcttcataagcttcccagggtgtggttcttcttctaaaagcttgtatgaattgctgtactgtctctttatagtttaaaaatgaatccttttttgttctttgcaactcatttgcttttttcttttcttttctttaaattactattaacacctgttgattctttttttttttctgattggcctgtcactgcattcctgctccccctccctctagctgggtttgtcaagtcgcccatgtcagaaactaagctcacgggggacgcctttgagctgtactgtgacgtggtcgggagccccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggccagcaacgaccccaagaggaatgacttgaggcaaaacccctccataacatggattcgagcccaggccaccataagcgtccttcagaagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363216 - DNA, 1853 bp, Homo sapiens
gcctgcagttcgacttaagatcccgactacatacttccgagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363217 - DNA, 1736 bp, Homo sapiens
tcctctttctgctgtggtttcttacctggtgttggaggcagcatttactaggttgttggacttttctgagtctccaggcagtaggacctgcactcacttcgtggaagtcggggaagtctggaggaccaagcgtaagccagccttgcctggctctgtcagaagttgatctgctgttgttcacacgcaagccaaatcattaatcaaatgttcctagacactgcttcctcattctgcctggtgcctaaaaagaacggagagcagtgtcaccctctcttgaacattagctcagttactcactctcacctttgtgtattctcacttttttgcaggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363218 - DNA, 1154 bp, Homo sapiens
gtgacattgcagaaataaagatatcgcacacggctcgaaacacgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363219 - DNA, 1038 bp, Homo sapiens
gagctcggtaccctcttctccgaaaggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363220 - DNA, 2468 bp, Homo sapiens
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaagaaaaaaaaacatactatagaccaccagcactgttatctacaacacccggcgtcgactaccgacgcagtccctcacatcgcagcacgccatcctgactgcggaccacacccactctacttatcgcacacacactacgcgcggccggacatcccttagcggacagccacaccatctcatcgcggcaccggacaatccccagtcgaacacacacccaactcactccaagcgcgccctcctccgaccactc

SEQ ID NO: 363221 - DNA, 998 bp, Homo sapiens
  misc_feature (859)..(859): n is a, c, g, or t
  misc_feature (867)..(867): n is a, c, g, or t
  misc_feature (917)..(917): n is a, c, g, or t
  misc_feature (970)..(970): n is a, c, g, or t
  misc_feature (996)..(996): n is a, c, g, or t
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttctttgctatgtgacccccagagccctcagtgatccagaaccaaggcctccccagccctctaaaacagtgcctccccactatcctgtggtgtgttgccccacttcgggtcctcagatgtgtancaagcggncagcccgagggagagccacacttgggagccagcgaaacgccggaagtcantgacaccagatcccaaggagaagcagacatgtgacatcagactgggggtttcnggcttgaatactggcagcattgagantg

SEQ ID NO: 363222 - DNA, 624 bp, Homo sapiens
  misc_feature (594)..(594): n is a, c, g, or t
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcttnatctggggcccagcctgctggtccggctcg

SEQ ID NO: 363223 - DNA, 577 bp, Homo sapiens
ttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatgtttggataatactctttatt

SEQ ID NO: 363224 - DNA, 2044 bp, Homo sapiens
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccacctggccccactctggcctttcttgggaattctggctgaaattatcatccttgtggtgatcattgttgtgtatgagaagaggaagaggccagatgaggttcctgacggaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363225 - DNA, 1964 bp, Homo sapiens
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363226 - DNA, 2067 bp, Homo sapiens
  misc_feature (832)..(832): n is a, c, g, or t
  misc_feature (837)..(837): n is a, c, g, or t
  misc_feature (839)..(839): n is a, c, g, or t
  misc_feature (845)..(845): n is a, c, g, or t
  misc_feature (849)..(849): n is a, c, g, or t
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccacctggncccantntgggcntttnttggggattttgggctgaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatg

SEQ ID NO: 363227 - DNA, 2170 bp, Homo sapiens
  misc_feature (2120)..(2120): n is a, c, g, or t
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggacattgtcaatacctctggccgcttcttcatcatcaacaaggaaaattacactgagttgaacattgtgaacctgcagatcacggaagaccctggcgagtatgaatgtaatgccaccaacgccattggctccgcctctgttgtcactgtcctcagggtgcggagccacctggccccactctggcctttcttgggaattctggctgaaattatcatccttgtggtgatcattgttgtgtatgagaagaggaagaggccagatgaggttcctgacgatgatgaaccagctggaccaatgaaaaccaactctaccaacaatcacaaagataaaaacttgcgccagagaaacacaaattaagtactgcttacaatatctttaggttcctgaaactggtggcaacatgacctgctaaaattttctgcttggacctctttggttctctcccctttcaagtgagcaacaccacaatgactgtctaaagcatgccttatttagcctctcctgtaagggtgatctagccaggtacattttaaacaatgcttcagtgtagaaggtgtaaactattttgggcttgatgtgctgtgaatgttgcttttttttttcctttgttaaaatatttaaatagaagtgaaaaggtcctctgaggatcagatcatgcatgcgccattttttacttaatgcagctgttaaattggcaaagctctaaaatgcactgctgccatctagtgatacacttttgtaaagtacagcaaaacctacagatatatacagtatataaatatatatatatatatatttatatttttgggggtgggagaaatccaaaataaagtaaatgcttgtttcatttttaagctgctgatattcattccttattgtatgttgtcagatgaggaaattgtgcagttctggtacataaagatgagtaatataaactgaaatctataattttaagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattattgaagtgcaatgatgtataaaaaagtggattcacctgtttttaaaaataaaacattgataaaaaaatganaaaaaaaaataagggcggcggctcgcgatctggaattagcccacgcgtcc

SEQ ID NO: 363228 - DNA, 931 bp, Homo sapiens
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtgagaacaagaatgaagggcaggatgccactatgtattgcaagtcagttggctacccccacccagactggatatggcgcaagaaggagaacgggatgcccatggtgagtaggaggcaggcccgggtctctggttgctggagttttccctgcagaggtccagacacgtgggtcagttactgtagtagctgtatcctcggatgtgtgcatggcgagggtcaccctttctagagtcacggtttacagcatgaatcaagaggtcattgacagtctcttccagcacaaaaatccctgtacgtgatttgttaaagctgtccctctggta

SEQ ID NO: 363229 - DNA, 812 bp, Homo sapiens
ggcggtcgctcctcagccgcccacgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggtgagagtggtgggcagctcctgggaaggtgggagggagtgtggctgagcttacttgacattcataatccatagttgcgccatgcagaagggacatgagatatatttggttctccctttgagagtccaatccagtatctcaggtaaggcccagtagtctagaaaagattcccaaaggattctaatgagcagccagattggagaatcatagatgatcccctcactataatcatagagaaactgaggctgtgaagtagtgatttgttcagggtaacaatgttagtcaataggagagtcacacttagaatgtagtctcttgacctaatccagt

SEQ ID NO: 363230 - DNA, 330 bp, Homo sapiens
tgggagttgggtgataggaggaggtttttgaataaaatgaagaaatctcaagctgagcttgacatatggagaggaaactaacatgcgtataaaagaggcaaaccatagcaggccagtttattctgctgtgttctggatgctctggcttggagtcactctaattggagccatggctaattttgtgctttgtgcgatgtgaggatttgctaaataaagactatgtaaacctttcatctcaagcatcccagttactctgtctctctggaaactctggggactaggaagctcaggagttactaacaatgagtattaaaatcagaaagatatgga

SEQ ID NO: 363231 - DNA, 805 bp, Homo sapiens
tttttttttctattattcttttactattttttctattaccattttttctagtaccattttttctattattcttttactataattgtatataatatggcagctgcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactctccttgattcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaaggtgagctgggagatggaggctttttaagagtcattctctgaggaaaggtttagcttcc

SEQ ID NO: 363232 - DNA, 4370 bp, Homo sapiens
cctgagtcacccggcgggcgaggtataaagcccgatacctgccccgcgcccggtccgcggagcccgctgcagctcccgctcgctccggacgcggaatcgggcagcagcgggaggcggcccggagagccgagggaccctctgaagctccagcaactccagaaccaaatccgactggagcaggaggccggcgctcggcagcctccgccagccccgcgcagcgcgccgccctcgcccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgccccgcgccccgccacccccggtcttcagccccacggctgccttcccggtgcccgacgtgttcccactgccgccgccaccaccgccgctcccgagcccgggacaggcgtcccactgctcgtcgcctgccacccgcttcggccacggccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataatagttgcagttttgtgaagc

SEQ ID NO: 363233 - DNA, 2905 bp, Homo sapiens
tttaaaatcattaaatactttatttaagaacagtttgtttaccaagttaggacagtggttatgatttctcaatttacacatattccttttgaaaatcttagaaaaaatgtttcaccaatgttaaggtacaactcttgaatatgcagcgtagtcttctctctttattctgaataacagaagcacgtaaattaaattatcctctttgcacaattattccccccaaaactaatttataacatataattatctccctaaaaagcagttacaaaccataaattgaatatgaataaaatatgaaaaagagcacaaattttaaagccctccatgcaaaaaaaaattaatacattggctttacctataaaccttattttgttaatgctaagcacagaacccttatgggctcataggagtcagcaaacagctacagatgagtcttcttgttaagaattcattcaatgcttctcagaatagcagattttaaaaaatgaattcactgaggttcttaaacctctgaacataaggcaacagttcacaactgatttcagaaatagaaggtaagtattaaattacaaattctactaggtcagtgggagtgggcggattcacctggagtggagcagtgaaggtttattttacctctttcaagatctctccatatattccaccagtttgagataggctgggggaggaggtggaatagcttaaaaggttatatttcttattttaaagtataaaaacatacacttaaaggctaaacctatctataacctacatcttaatgtcagcaaaacatactgctttctacccaaatcaccaattgaatcagcctcgctcatgatttcagagcataaggtgtccagagaagaaaactcaagactgaatgggctgccataatggggaagtacaggtagccaaaggccagcaattgagacagcattagagaaactatctactatgtctgaataagctcccctaccttacaagcatcaactactacattgaaaccattctgagtgctgcatttcctatatgtgcctagacttggtaatgcctgataaattctgtatattaccacgtcttgcatttaatagacaatttgtttaatgatactaactttactcacacttaattgactttctcatatcctgagattaatctaagaaaactatttcaaagataaatttaaaataatttttaaggaacccagaatttttatttagaacactgctttgacttttgttattactttgtatttattagtatatcctattcataattttgcactgactttcaatataaaattaaatctctgcttacacaaaataactgtcagctccaaatcaacatgaatggagtgacattgaaaatatcatactattcccgataaaaagagtttaatgcaaaataattattacctggtatttcacattcggtttgtgtctttatctctactcccaggcaaatattctcacttaagaccagtgccttcactgcttcttgtaaagacatttaatttaatgttattgcatatttatttattttttatgcttattcatacagaatttattactttctagaattttgggataagaatcataatcactaatgcaaaatactcttaattttttaaatgttgtatttctcgtttttaaatattaatagttcactattctaagtttttcatgaataaaaaacacatcctaagttcatgaaatctgtgcggttcactactgtaccaggtattaaaaccttaagggctaatcctcttcacttatgagaatttctcaagaatgagtcaaatgcgccacatttaaatttgcagattattttgtctagctgctcaatcaagagaaataccactcaaagaaatcaattctaaattcatgtctttaatgaatactatgttttgcaacctgtataaaaactgatcacccaagcacatgcaaaaggaatatagttatctttagtgggcttgctaaagtattgacaactaatcagtgtcctctaaatactcttattttggcaacagcccacaaggttaacttttagaaaattcagcttgatacaagaaaataattcatcataattagacaatataatttttccacttttgagacaaaatatataaatcaatacttgtttatatgacttgcaaaatgtctatacactaagattgctacagtctatgaggtaaccaaaggtaagtgatacacatcctttagaaaacacaatttgtctggggggatgattgcacatgtatttaaatatgttaaaaccactgaattgtgtattttaaatgtgtgattatatggtatgtgaattgtatctcatgaaggctttttaaacaaaacaacactgatgtaacttagaccaaaaaaaaaaaaaccacaatttgtcacacattgttcttttgagacatatttttataaagacagaaattaacatttgtagcatcagcaggtttgattagcacatgttacccatgtaggtataattgtctaatcagtagccaaagtgtgcccttgatgctaatcacccctataactgaataatctgcaaattacaaaatgagttgtaatcccccatccactaccagaacatgccctgtaatatacggtgattctaaaagaaacacaaccgcatgtgccacctcaatagtttctccaaacctcccaagaggaatatttttctttaaatgttcttctttcaagtctttcgtcatatctgtgtgtacaaatcctaaaagagaaatgtttgtttagttgaaaagggtacacactaagacatctgctgaatttcaaaaaaaataataaatttgtttctgaaaattttaatttgaaattatttaaaaaaaaatttttttttgagacagggtctcactctgtcacccaagctagaatgcagt

SEQ ID NO: 363234 - DNA, 1532 bp, Homo sapiens
ttttttcggtacagacagcatcttgctatgttgctcaggctgatctggaactcctggcctcacaatactcctgcctcagcctcccacatgagctaccatacctggtaggacattatttttaagctcccattaggtggaaatcaaaagacaaagcttttagtaacagttcttccataaactagctgtgtaatcttaggcaagtcactctgaatcccaggtacagttttctaatctacaaaaatgactggaaaaaattatttctaagaccctctccaccttaagttattccactagtgcaaaatttaaaaataaagactcttatggtttggatgtttgtcccctccaaatctcatgttgaaatgtgattcccaatgttggaggtgggcctagcgggaggtgtttgggtcatggaggcggattcctcatgaatagcttggtgccctccacatggtaaataatgagttctcactgttagttcatgccagagctggttgtttagagcctgccacctcctctctctcttgctcctgctatccccatatgacttggctgctacctctttaccttccgccatgactgaaaaaaagtttcctgggcctcaccagaagctgagcagatgttggtgtcatgcttgtacagcctgcaggcccgagagccaaataagcctcttttttttatgaattacctcagacagtcctttagagcaatgcaaacaggctaacacatagactttatatagaatatgaggtacaaaaaatttttttgagtcccccagttcattatttgattcttttcacaatcattttacaaactattctacccagatgtcaattactaatgttccaaataatggcttccctataaaacaataatcataatcaagttattttaataaagttttcactaacctggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatcatagtcctcatggcagctttacaggtcagcatggaacccaagaggttagtatgaagctgagataccatatcttcagtttttgttcttactaaaagaccatccctgttaataccagctgcatttaccaagaaatttactcgacctaaatgtttctccatctcttcaaatgtattttgaacatcatgttctttagcaacatcacagctaaatgccaaatgatctccgccgaggtcaccggcggcggctttggccccttccaggtttctggcaatgaccgccagtcggtagcctttccgggccattaactgggccacagctctgccaatgcctcgggagcctccaaaaacagcacacactttgtccatctcggagtcacaaactcggaggaaagaaggtagagagtgggagcccccctccaggttccctcaggcttttaaacaaccgcggttccaaa

SEQ ID NO: 363235 - DNA, 904 bp, Homo sapiens
tcatgaaagtgtgttgttttttactctttttcatagggcagtacatatttgtgatttttttctaattttgtattttttgtgacttacgttgttaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatcatagtcctcatggcagctttacaggtcagcatggaacccaagaggttagtatgaagctgagataccatatcttcagtttttgttcttactaaaagaccatccctgttaataccagctgcatttaccaagaaatttactcgacctaaatgtttctccatctcttcaaatgtattttgaacatcatgttctttagcaacatcacagctaaatgccaaatgatctccgccgaggtcaccggcggcggctttggccccttccaggtttctggcaatgaccgccagtcggtagcctttccgggccattaactgggccacagctctgccaatgcctcgggagcctccaaaaacagcacacactttgtccatctcggagtcacaaactcggaggaaagaaggtagagagtgggagcccccctccaggttccctcaggcttttaaacaaccgcggttccaaa

SEQ ID NO: 363236 - DNA, 563 bp, Homo sapiens
atcacctttaagttcgtaacttttatatttctatacttttaactgttacattaatcctgtcttattcaaaaggtattcaccacaaaaatacttactaatcttggtttcctggtatgaactccttgtgcttctgagattagagatacgcttttctttacgggtggccacaatcaagagataagatcatgcaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatgtcgacgcggccgcgaat

SEQ ID NO: 363237 - DNA, 392 bp, Homo sapiens
atcacctttaagttcgtaacttttatatttctatacttttaactgttacattaatcctgtcttattcaaaaggtattcaccacaaaaatacttactaatcttggtttcctggtatgaactccttgtgcttctgagattagagatacgcttttctttacgggtggccacaatcaagagataagatcatgccttggtgtcatcacttgagaggctaagagtgaagcaacctagttactactctgggctctgttggtggcctcctgtgtggcactgcaccaaacgtacttattactcagctggatgagatgatcccggttccttccatccacatgttccatgctttcctgtgtatctcggcgcacagatactatacatacttcagtggctttttc

SEQ ID NO: 363238 - DNA, 4051 bp, Homo sapiens
  misc_feature (54)..(54): n is a, c, g, or t
  misc_feature (72)..(72): n is a, c, g, or t
aaaaagaaagaaaccaaaagcccaaatgtatctgccgtcctaagggctatagcngaagtgccccctgggtgngtgttttaaaaacttctcggcacggaggctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgccccgcgcccggctgccttcccggtgcccgacgtgttcccactgccgccgccaccaccgccgctcccgagcccgggacaggcgtcccactgctcgtcgcctgccacccgcttcggccacggccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataatagttgcagttttgtgaagc

SEQ ID NO: 363239 - DNA, 3619 bp, Homo sapiens
atggctagtagaggccggcggtgaatcggccgaggccaaggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataatagttgcagttttgtgaagc

SEQ ID NO: 363240 - DNA, 3447 bp, Homo sapiens
tttaaaatcattaaatactttatttaagaacagtttgtttaccaagttaggacagtggttatgatttctcaatttacacatattccttttgaaaatcttagaaaaaatgtttcaccaatgttaaggtacaactcttgaatatgcagcgtagtcttctctctttattctgaataacagaagcacgtaaattaaattatcctctttgcacaattattccccccaaaactaatttataacatataattatctccctaaaaagcagttacaaaccataaattgaatatgaataaaatatgaaaaagagcacaaattttaaagccctccatgcaaaaaaaaattaatacattggctttacctataaaccttattttgttaatgctaagcacagaacccttatgggctcataggagtcagcaaacagctacagatgagtcttcttgttaagaattcattcaatgcttctcagaatagcagattttaaaaaatgaattcactgaggttcttaaacctctgaacataaggcaacagttcacaactgatttcagaaatagaaggtaagtattaaattacaaattctactaggtcagtgggagtgggcggattcacctggagtggagcagtgaaggtttattttacctctttcaagatctctccatatattccaccagtttgagataggctgggggaggaggtggaatagcttaaaaggttatatttcttattttaaagtataaaaacatacacttaaaggctaaacctatctataacctacatcttaatgtcagcaaaacatactgctttctacccaaatcaccaattgaatcagcctcgctcatgatttcagagcataaggtgtccagagaagaaaactcaagactgaatgggctgccataatggggaagtacaggtagccaaaggccagcaattgagacagcattagagaaactatctactatgtctgaataagctcccctaccttacaagcatcaactactacattgaaaccattctgagtgctgcatttcctatatgtgcctagacttggtaatgcctgataaattctgtatattaccacgtcttgcatttaatagacaatttgtttaatgatactaactttactcacacttaattgactttctcatatcctgagattaatctaagaaaactatttcaaagataaatttaaaataatttttaaggaacccagaatttttatttagaacactgctttgacttttgttattactttgtatttattagtatatcctattcataattttgcactgactttcaatataaaattaaatctctgcttacacaaaataactgtcagctccaaatcaacatgaatggagtgacattgaaaatatcatactattcccgataaaaagagtttaatgcaaaataattattacctggtatttcacattcggtttgtgtctttatctctactcccaggcaaatattctcacttaagaccagtgccttcactgcttcttgtaaagacatttaatttaatgttattgcatatttatttattttttatgcttattcatacagaatttattactttctagaattttgggataagaatcataatcactaatgcaaaatactcttaattttttaaatgttgtatttctcgtttttaaatattaatagttcactattctaagtttttcatgaataaaaaacacatcctaagttcatgaaatctgtgcggttcactactgtaccaggtattaaaaccttaagggctaatcctcttcacttatgagaatttctcaagaatgagtcaaatgcgccacatttaaatttgcagattattttgtctagctgctcaatcaagagaaataccactcaaagaaatcaattctaaattcatgtctttaatgaatactatgttttgcaacctgtataaaaactgatcacccaagcacatgcaaaaggaatatagttatctttagtgggcttgctaaagtattgacaactaatcagtgtcctctaaatactcttattttggcaacagcccacaaggttaacttttagaaaattcagcttgatacaagaaaataattcatcataattagacaatataatttttccacttttgagacaaaatatataaatcaatacttgtttatatgacttgcaaaatgtctatacactaagattgctacagtctatgaggtaaccaaaggtaagtgatacacatcctttagaaaacacaatttgtctggggggatgattgcacatgtatttaaatatgttaaaaccactgaattgtgtattttaaatgtgtgattatatggtatgtgaattgtatctcatgaaggctttttaaacaaaacaacactgatgtaacttagaccaaaaaaaaaaaaaccacaatttgtcacacattgttcttttgagacatatttttataaagacagaaattaacatttgtagcatcagcaggtttgattagcacatgttacccatgtaggtataattgtctaatcagtagccaaagtgtgcccttgatgctaatcacccctataactgaataatctgcaaattacaaaatgagttgtaatcccccatccactaccagaacatgccctgtaatatacggtgattctaaaagaaacacaaccgcatgtgccacctcaatagtttctccaaacctcccaagaggaatatttttctttaaatgttcttctttcaagtctttcgtcatatctgtgtgtacaaatcctctgaagcctttgcagttccagtcccaagattacactcatatacttgcaaatgtgcaaaataaactccatacaagtattgtcactggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatcatagtcctcatggcagctttacaggtcagcatggaacccaagaggttagtatgaagctgagataccatatcttcagtttttgttcttactaaaagaccatccctgttaataccagctgcatttaccaagaaatttactcgacctaaatgtttctccatctcttcaaatgtattttgaacatcatgttctttagcaacatcacagctaaatgccaaatgatctccgccgaggtcaccggcggcggctttggccccttccaggtttctggcaatgaccgccagtcggtagcctttccgggccattaactgggccacagctctgccaatgcctcgggagcctccaaaaacagcacacactttgtccatctcggagtcacaaactcggaggaaagaaggtagagagtgggagcccccctccaggttccctcaggcttttaaacaaccgcggttccaaa

SEQ ID NO: 363241 - DNA, 3771 bp, Homo sapiens
tttaaaatcattaaatactttatttaagaacagtttgtttaccaagttaggacagtggttatgatttctcaatttacacatattccttttgaaaatcttagaaaaaatgtttcaccaatgttaaggtacaactcttgaatatgcagcgtagtcttctctctttattctgaataacagaagcacgtaaattaaattatcctctttgcacaattattccccccaaaactaatttataacatataattatctccctaaaaagcagttacaaaccataaattgaatatgaataaaatatgaaaaagagcacaaattttaaagccctccatgcaaaaaaaaattaatacattggctttacctataaaccttattttgttaatgctaagcacagaacccttatgggctcataggagtcagcaaacagctacagatgagtcttcttgttaagaattcattcaatgcttctcagaatagcagattttaaaaaatgaattcactgaggttcttaaacctctgaacataaggcaacagttcacaactgatttcagaaatagaaggtaagtattaaattacaaattctactaggtcagtgggagtgggcggattcacctggagtggagcagtgaaggtttattttacctctttcaagatctctccatatattccaccagtttgagataggctgggggaggaggtggaatagcttaaaaggttatatttcttattttaaagtataaaaacatacacttaaaggctaaacctatctataacctacatcttaatgtcagcaaaacatactgctttctacccaaatcaccaattgaatcagcctcgctcatgatttcagagcataaggtgtccagagaagaaaactcaagactgaatgggctgccataatggggaagtacaggtagccaaaggccagcaattgagacagcattagagaaactatctactatgtctgaataagctcccctaccttacaagcatcaactactacattgaaaccattctgagtgctgcatttcctatatgtgcctagacttggtaatgcctgataaattctgtatattaccacgtcttgcatttaatagacaatttgtttaatgatactaactttactcacacttaattgactttctcatatcctgagattaatctaagaaaactatttcaaagataaatttaaaataatttttaaggaacccagaatttttatttagaacactgctttgacttttgttattactttgtatttattagtatatcctattcataattttgcactgactttcaatataaaattaaatctctgcttacacaaaataactgtcagctccaaatcaacatgaatggagtgacattgaaaatatcatactattcccgataaaaagagtttaatgcaaaataattattacctggtatttcacattcggtttgtgtctttatctctactcccaggcaaatattctcacttaagaccagtgccttcactgcttcttgtaaagacatttaatttaatgttattgcatatttatttattttttatgcttattcatacagaatttattactttctagaattttgggataagaatcataatcactaatgcaaaatactcttaattttttaaatgttgtatttctcgtttttaaatattaatagttcactattctaagtttttcatgaataaaaaacacatcctaagttcatgaaatctgtgcggttcactactgtaccaggtattaaaaccttaagggctaatcctcttcacttatgagaatttctcaagaatgagtcaaatgcgccacatttaaatttgcagattattttgtctagctgctcaatcaagagaaataccactcaaagaaatcaattctaaattcatgtctttaatgaatactatgttttgcaacctgtataaaaactgatcacccaagcacatgcaaaaggaatatagttatctttagtgggcttgctaaagtattgacaactaatcagtgtcctctaaatactcttattttggcaacagcccacaaggttaacttttagaaaattcagcttgatacaagaaaataattcatcataattagacaatataatttttccacttttgagacaaaatatataaatcaatacttgtttatatgacttgcaaaatgtctatacactaagattgctacagtctatgaggtaaccaaaggtaagtgatacacatcctttagaaaacacaatttgtctggggggatgattgcacatgtatttaaatatgttaaaaccactgaattgtgtattttaaatgtgtgattatatggtatgtgaattgtatctcatgaaggctttttaaacaaaacaacactgatgtaacttagaccaaaaaaaaaaaaaccacaatttgtcacacattgttcttttgagacatatttttataaagacagaaattaacatttgtagcatcagcaggtttgattagcacatgttacccatgtaggtataattgtctaatcagtagccaaagtgtgcccttgatgctaatcacccctataactgaataatctgcaaattacaaaatgagttgtaatcccccatccactaccagaacatgccctgtaatatacggtgattctaaaagaaacacaaccgcatgtgccacctcaatagtttctccaaacctcccaagaggaatatttttctttaaatgttcttctttcaagtctttcgtcatatctgtgtgtacaaatcctctgaagcctttgcagttccagtcccaagattacactcatatacttgcaaatgtgcaaaataaactccatacaagtattgtcactggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatcatagtcctcatggcagctttacaggtcagcatggaacccaagaggttagtatgaagctgagataccatatcttcagtttttgttcttactaaaagaccatccctgttaataccagctgcatttaccaagaaatttactcgacctaaatgtttctccatctcttcaaatgtattttgaacatcatgttctttagcaacatcacagctaaatgccaaatgatctccaaaacaatgttaataacattaaagcaaaccaggtatatctcaaaactggctggtactcaaaagggtttctctatcaaacactgctttgtgcattcgcgcagggccaaggcacggcccttgggcaaaactgaagggagccgttggtacctgcactcccacctttcctgcctgaactcctttcgacccagccctgtctccgggggccgagaactcgcccttttccctacattaaaagtaaactgttacgtggctctctcccacaacagggaagctcctcagcgttagcactagccgcagggcggagggtgcgtatagcggggcctcaaaagactacgaggtctcaaagaacaccccaagtgttcagccctcggcggcaagctgcgtggccggcattctgcgaggcatagggagatcgcgggtttctgcacgagacgcattctacccttggaacgggagagcgcctgcacgcggctacatcgagtatgacccatgagccattgaataggaattgatccacttctccttacaaaagcaagcaatgtatctaagcacca

SEQ ID NO: 363242 - DNA, 3762 bp, Homo sapiens
tttaaaatcattaaatactttatttaagaacagtttgtttaccaagttaggacagtggttatgatttctcaatttacacatattccttttgaaaatcttagaaaaaatgtttcaccaatgttaaggtacaactcttgaatatgcagcgtagtcttctctctttattctgaataacagaagcacgtaaattaaattatcctctttgcacaattattccccccaaaactaatttataacatataattatctccctaaaaagcagttacaaaccataaattgaatatgaataaaatatgaaaaagagcacaaattttaaagccctccatgcaaaaaaaaattaatacattggctttacctataaaccttattttgttaatgctaagcacagaacccttatgggctcataggagtcagcaaacagctacagatgagtcttcttgttaagaattcattcaatgcttctcagaatagcagattttaaaaaatgaattcactgaggttcttaaacctctgaacataaggcaacagttcacaactgatttcagaaatagaaggtaagtattaaattacaaattctactaggtcagtgggagtgggcggattcacctggagtggagcagtgaaggtttattttacctctttcaagatctctccatatattccaccagtttgagataggctgggggaggaggtggaatagcttaaaaggttatatttcttattttaaagtataaaaacatacacttaaaggctaaacctatctataacctacatcttaatgtcagcaaaacatactgctttctacccaaatcaccaattgaatcagcctcgctcatgatttcagagcataaggtgtccagagaagaaaactcaagactgaatgggctgccataatggggaagtacaggtagccaaaggccagcaattgagacagcattagagaaactatctactatgtctgaataagctcccctaccttacaagcatcaactactacattgaaaccattctgagtgctgcatttcctatatgtgcctagacttggtaatgcctgataaattctgtatattaccacgtcttgcatttaatagacaatttgtttaatgatactaactttactcacacttaattgactttctcatatcctgagattaatctaagaaaactatttcaaagataaatttaaaataatttttaaggaacccagaatttttatttagaacactgctttgacttttgttattactttgtatttattagtatatcctattcataattttgcactgactttcaatataaaattaaatctctgcttacacaaaataactgtcagctccaaatcaacatgaatggagtgacattgaaaatatcatactattcccgataaaaagagtttaatgcaaaataattattacctggtatttcacattcggtttgtgtctttatctctactcccaggcaaatattctcacttaagaccagtgccttcactgcttcttgtaaagacatttaatttaatgttattgcatatttatttattttttatgcttattcatacagaatttattactttctagaattttgggataagaatcataatcactaatgcaaaatactcttaattttttaaatgttgtatttctcgtttttaaatattaatagttcactattctaagtttttcatgaataaaaaacacatcctaagttcatgaaatctgtgcggttcactactgtaccaggtattaaaaccttaagggctaatcctcttcacttatgagaatttctcaagaatgagtcaaatgcgccacatttaaatttgcagattattttgtctagctgctcaatcaagagaaataccactcaaagaaatcaattctaaattcatgtctttaatgaatactatgttttgcaacctgtataaaaactgatcacccaagcacatgcaaaaggaatatagttatctttagtgggcttgctaaagtattgacaactaatcagtgtcctctaaatactcttattttggcaacagcccacaaggttaacttttagaaaattcagcttgatacaagaaaataattcatcataattagacaatataatttttccacttttgagacaaaatatataaatcaatacttgtttatatgacttgcaaaatgtctatacactaagattgctacagtctatgaggtaaccaaaggtaagtgatacacatcctttagaaaacacaatttgtctggggggatgattgcacatgtatttaaatatgttaaaaccactgaattgtgtattttaaatgtgtgattatatggtatgtgaattgtatctcatgaaggctttttaaacaaaacaacactgatgtaacttagaccaaaaaaaaaaaaaccacaatttgtcacacattgttcttttgagacatatttttataaagacagaaattaacatttgtagcatcagcaggtttgattagcacatgttacccatgtaggtataattgtctaatcagtagccaaagtgtgcccttgatgctaatcacccctataactgaataatctgcaaattacaaaatgagttgtaatcccccatccactaccagaacatgccctgtaatatacggtgattctaaaagaaacacaaccgcatgtgccacctcaatagtttctccaaacctcccaagaggaatatttttctttaaatgttcttctttcaagtctttcgtcatatctgtgtgtacaaatcctctgaagcctttgcagttccagtcccaagattacactcatatacttgcaaatgtgcaaaataaactccatacaagtattgtcactggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatcatagtcctcatggcagctttacaggtcagcatggaacccaagaggttagtatgaagctgagataccatatcttcagtttttgttcttactaaaagaccatccctgttaataccagctgcatttaccaagaaatttactcgacctaaatgtttctccatctcttcaaatgtattttgaacatcatgttctttagcaacatcacagctaaatgccaaatgatctccaaaacaatgttaataacattaaagcaaaccaggtatatctcaaaactggctggtactcaaaagggtttctctatcaaacactgctttgtgcattcgcgcagggccaaggcacggcccttgggcaaaactgaagggagccgttggtacctgcactcccacctttcctgcctgaactcctttcgacccagccctgtctccgggggccgagaactcgcccttttccctacattaaaagtaaactgttacgtggctctctcccacaacagggaagctcctcagcgttagcactagccgcagggcggagggtgcgtatagcggggcctcaaaagactacgaggtctcaaagaacaccccaagtgttcagccctcggcggcaagctgcgtggccggcattctgcgaggcatagggagatcgcgggtttctgcacgagacgcattctacccttggaacgggagagcgcctgcacgcggctacatcgagtaaccctagagccctaaaggccagacccgctctttttacaaaggagattttctttaggcgcctg

SEQ ID NO: 363243 - DNA, 3363 bp, Homo sapiens
tttaaaatcattaaatactttatttaagaacagtttgtttaccaagttaggacagtggttatgatttctcaatttacacatattccttttgaaaatcttagaaaaaatgtttcaccaatgttaaggtacaactcttgaatatgcagcgtagtcttctctctttattctgaataacagaagcacgtaaattaaattatcctctttgcacaattattccccccaaaactaatttataacatataattatctccctaaaaagcagttacaaaccataaattgaatatgaataaaatatgaaaaagagcacaaattttaaagccctccatgcaaaaaaaaattaatacattggctttacctataaaccttattttgttaatgctaagcacagaacccttatgggctcataggagtcagcaaacagctacagatgagtcttcttgttaagaattcattcaatgcttctcagaatagcagattttaaaaaatgaattcactgaggttcttaaacctctgaacataaggcaacagttcacaactgatttcagaaatagaaggtaagtattaaattacaaattctactaggtcagtgggagtgggcggattcacctggagtggagcagtgaaggtttattttacctctttcaagatctctccatatattccaccagtttgagataggctgggggaggaggtggaatagcttaaaaggttatatttcttattttaaagtataaaaacatacacttaaaggctaaacctatctataacctacatcttaatgtcagcaaaacatactgctttctacccaaatcaccaattgaatcagcctcgctcatgatttcagagcataaggtgtccagagaagaaaactcaagactgaatgggctgccataatggggaagtacaggtagccaaaggccagcaattgagacagcattagagaaactatctactatgtctgaataagctcccctaccttacaagcatcaactactacattgaaaccattctgagtgctgcatttcctatatgtgcctagacttggtaatgcctgataaattctgtatattaccacgtcttgcatttaatagacaatttgtttaatgatactaactttactcacacttaattgactttctcatatcctgagattaatctaagaaaactatttcaaagataaatttaaaataatttttaaggaacccagaatttttatttagaacactgctttgacttttgttattactttgtatttattagtatatcctattcataattttgcactgactttcaatataaaattaaatctctgcttacacaaaataactgtcagctccaaatcaacatgaatggagtgacattgaaaatatcatactattcccgataaaaagagtttaatgcaaaataattattacctggtatttcacattcggtttgtgtctttatctctactcccaggcaaatattctcacttaagaccagtgccttcactgcttcttgtaaagacatttaatttaatgttattgcatatttatttattttttatgcttattcatacagaatttattactttctagaattttgggataagaatcataatcactaatgcaaaatactcttaattttttaaatgttgtatttctcgtttttaaatattaatagttcactattctaagtttttcatgaataaaaaacacatcctaagttcatgaaatctgtgcggttcactactgtaccaggtattaaaaccttaagggctaatcctcttcacttatgagaatttctcaagaatgagtcaaatgcgccacatttaaatttgcagattattttgtctagctgctcaatcaagagaaataccactcaaagaaatcaattctaaattcatgtctttaatgaatactatgttttgcaacctgtataaaaactgatcacccaagcacatgcaaaaggaatatagttatctttagtgggcttgctaaagtattgacaactaatcagtgtcctctaaatactcttattttggcaacagcccacaaggttaacttttagaaaattcagcttgatacaagaaaataattcatcataattagacaatataatttttccacttttgagacaaaatatataaatcaatacttgtttatatgacttgcaaaatgtctatacactaagattgctacagtctatgaggtaaccaaaggtaagtgatacacatcctttagaaaacacaatttgtctggggggatgattgcacatgtatttaaatatgttaaaaccactgaattgtgtattttaaatgtgtgattatatggtatgtgaattgtatctcatgaaggctttttaaacaaaacaacactgatgtaacttagaccaaaaaaaaaaaaaccacaatttgtcacacattgttcttttgagacatatttttataaagacagaaattaacatttgtagcatcagcaggtttgattagcacatgttacccatgtaggtataattgtctaatcagtagccaaagtgtgcccttgatgctaatcacccctataactgaataatctgcaaattacaaaatgagttgtaatcccccatccactaccagaacatgccctgtaatatacggtgattctaaaagaaacacaaccgcatgtgccacctcaatagtttctccaaacctcccaagaggaatatttttctttaaatgttcttctttcaagtctttcgtcatatctgtgtgtacaaatcctggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatcatagtcctcatggcagctttacaggtcagcatggaacccaagaggttagtatgaagctgagataccatatcttcagtttttgttcttactaaaagaccatccctgttaataccagctgcatttaccaagaaatttactcgacctaaatgtttctccatctcttcaaatgtattttgaacatcatgttctttagcaacatcacagctaaatgccaaatgatctccgccgaggtcaccggcggcggctttggccccttccaggtttctggcaatgaccgccagtcggtagcctttccgggccattaactgggccacagctctgccaatgcctcgggagcctccaaaaacagcacacactttgtccatctcggagtcacaaactcggaggaaagaaggtagagagtgggagcccccctccaggttccctcaggcttttaaacaaccgcggttccaaa

SEQ ID NO: 363244 - DNA, 2567 bp, Homo sapiens
ggtggtgctgctgtcctggtggtgctgctgtcctggtggtgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataatagttgcagttttgtgaagc

SEQ ID NO: 363245 - DNA, 2022 bp, Homo sapiens
cctgagtcacccggcgggcgaggtataaagcccgatacctgccccgcgcccggtccgcggagcccgctgcagctcccgctcgctccggacgcggaatcgggcagcagcgggaggcggcccggagagccgagggaccctctgaagctccagcaactccagaaccaaatccgactggagcaggaggccggcgctcggcagcctccgccagccccgcgcagcgcgccgccctcgcccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgccccgcgccccgccacccccggtcttcagccccacggctgccttcccggtgcccgacgtgttcccactgccgccgccaccaccgccgctcccgagcccgggacaggcgtcccactgctcgtcgcctgccacccgcttcggccacggccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggtatttaacatgttccttcccagaagtgttacattattttatttattactataaatgtagtactattagaatcatcatatgaccacaaaagtaaacataactggaagatagaataggaatgcaaacctgaagcctgtggctccttgattattatgctcccttgtgatgcagaaagggaatgggaacaaacattcgctaatgtgtgctaagcccattcacatatactattagtttgttaaataagacatattttatagacaaataaatcaagactcagcacttttaaatggcatatgaaaatactactaaatggtacacaaatgttggaaaccaaacttctgtaaccaacagctgtgtgagtggacgcacacattaaaagctattaccactgggtttcttaaaatcagctcatttgttaatgttcatttttcagccacttagttcaaaacataagaccattagactacaaatcttgtaggtaagatctgtcacattttaaatactcagatatctgct

SEQ ID NO: 363246 - DNA, 1307 bp, Homo sapiens
cctgagtcacccggcgggcgaggtataaagcccgatacctgccccgcgcccggtccgcggagcccgctgcagctcccgctcgctccggacgcggaatcgggcagcagcgggaggcggcccggagagccgagggaccctctgaagctccagcaactccagaaccaaatccgactggagcaggaggccggcgctcggcagcctccgccagccccgcgcagcgcgccgccctcgcccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgccccgcgccccgccacccccggtcttcagccccacggctgccttcccggtgcccgacgtgttcccactgccgccgccaccaccgccgctcccgagcccgggacaggcgtcccactgctcgtcgcctgccacccgcttcggccacggccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctgtggaaagtagagggcaagtcacagaaaagcagtattaatatcatcagtcaacctcacagctaatttttattgagcacatactatgttaagtgactgacagaattctttccatcagtgatacctgttctttttattcttcttcttgattattctcctttccagtacatttccattttc

SEQ ID NO: 363247 - DNA, 447 bp, Homo sapiens
cacccctaggcctctattctccccatgcctccctgatagtaaatgaagtataattttgtccattctggtgattaaacaaatagcatcttcggatctaacgtcctatttctccctaaactcaatgaagagttatattcacaaaatgactaatccattcataataagccggaaataaaaaaccctgaagtttaaatgcaataaaaaagaatttggcagaacaaagttcaattgtccatttgcaaaactcaccaaaacaatgttaataacattaaagcaaaccaggtatatctcaaaactggctggtactcaaaagggtttctctatcaaacactgctttgtgcattcgcgcagggccaaggcacggcccttgggcaaaactgaagggagccgttggtacctgcactcccacctttcctgcctgaactcctttcgacccagccctgtctc

SEQ ID NO: 363248 - DNA, 852 bp, Homo sapiens
ggcaaacggcagtgagggaatctaagtggtcaaattcctagaaatacttgtcctcagcaccactaggtggcagtagttggttgaggctgtgaatgatcggtaacataatcactagtagtgaagccatcacagatgctagcaatgacttaggagtctcccacagctggtcagacaggcattctgtgaagcagatggccagtggacagtgtgagcctatcagacttgaattaattgaggaaataaatgagcggaatgaagtatacagacctttgcttggtaaaagaataatttggagaggggactagcatcttaccacctggagtaaaaaatggtatcataaaagatctattcaagcaatattccaaaagccttctgaattctttctagtgctccttttgtatatcattgatagagaattcatctcatgttttcttagctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgaggtaagactgcacaatgagaacctgatccttaactgttcagtcctaatgatgtatcaaaagatacattttatatagcatggaaatctatgtgtaaaagccacatagatgttttgatttttgatgaaatcaatcaaagacaaaaaccatgcgttacccaatgtaggattaagcttttagaaggaagctatgggtgtttgatctaatggtgatttcttaaaagtgtttatcattctatctaaaagaaaagatg

SEQ ID NO: 363249 - DNA, 3856 bp, Homo sapiens
tttttttttctattattcttttactattttttctattaccattttttctagtaccattttttctattattcttttactataattgtatataatatggcagctgcttgccacatgtactatgtggagagatgtaccaccctgcatcagcttttaccctacagaaggaaatcagcgttccattatattttattgttatcaacagtttaggaatacatagctttgcttttgcctttttctttccttccccttgtttcccctcgcctcagagaaaagaaggaaaaaaaaattcatctttcctacccccctctttttggatgataggacttgaagacaatctgaaataccacataaactcacttccagatgttttttgtttcatatgcaattgaattgggctcagactgtgtttttaagctgtatggtaaaaatatcactgtcttctagggccttattggggggcagggagagacgtgacactttgtcagaagggattgagtctgctaacttaaactctccttgattcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataatagttgcagttttgtgaagc

SEQ ID NO: 363250 - DNA, 631 bp, Homo sapiens
cccttccttagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactgtgagtatttctgcatggttttataataatttccatacccctgttacatttcctgtctggtgagaaaaaaacttttgcctgtattcaactatgtggcaagttggccttgactcatgggaccttgctgccaagtggtgtctttcaacaatataaaagacacctaaaaataaagaagggaaatgaaaagcttggtgaaatctgccctttgctgaaagctataactggttatggctgtgaaaatatctgtgcccagtgtgggcttccaacatacagctaa

SEQ ID NO: 363251 - DNA, 4310 bp, Homo sapiens
cccttccttagccaacactgaaaactgtagttacgagtcaatgggagaatccaacaatgaccacttccaacactttccacctccccctccaatcttggagacaagttccttggagttggcttcaaagaaaccatctgagatccagcaggtgaacaaccctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactgggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgccccgcgccccgccacccccggtcttcagccccacggctgccttcccggtgcccgacgtgttcccactgccgccgccaccaccgccgctcccgagcccgggacaggcgtcccactgctcgtcgcctgccacccgcttcggccacggccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataatagttgcagttttgtgaagc

SEQ ID NO: 363252 - DNA, 3227 bp, Homo sapiens
cctgagtcacccggcgggcgaggtataaagcccgatacctgccccgcgcccggtccgcggagcccgctgcagctcccgctcgctccggacgcggaatcgggcagcagcgggaggcggcccggagagccgagggaccctctgaagctccagcaactccagaaccaaatccgactggagcaggaggccggcgctcggcagcctccgccagccccgcgcagcgcgccgccctcgcccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgccccgcgccccgccacccccggtcttcagccccacggctgccttcccggtgcccgacgtgttcccactgccgccgccaccaccgccgctcccgagcccgggacaggcgtcccactgctcgtcgcctgccacccgcttcggccacggccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccattctttgagatgaagctgaaacattacaagatctttgagggaatgccagtaactttcacatgtagagtggctggaaatccaaagccaaagatctattggtttaaagatgggaagcagatctctccaaagagtgatcactacaccattcaaagagatctcgatgggacctgctccctccataccacagcctccaccctagatgatgatgggaattatacaattatggctgcaaaccctcagggccgcatcagttgtactggacggctaatggtacaggctgtcaaccaaagaggtcgaagtccccggtctccctcaggccatcctcatgtcagaaggcctcgttctagatcaagggacagtggagacgaaaatgaaccaattcaggagcgattcttcagacctcacttcttgcaggctcctggagatctgactgttcaagaaggaaaactctgcagaatggactgcaaagtcagtgggttaccaaccccagatctaagctggcaactagatggaaagcccgtacgccctgacagtgctcacaagatgctggtgcgtgagaacggggtgcactctctgatcatagagccagtcacgtcacgtgatgccggcatctacacatgtatagctaccaaccgagcaggacagaactcattcagcctggagcttgtggttgctgctaaagaagcacacaaaccccctgtgtttattgagaagctccaaaacacaggagttgctgatgggtacccagtgcggctggaatgtcgtgtattgggagtgccaccacctcagatattttggaagaaagaaaatgaatcactcactcacagcactgaccgagtgagcatgcaccaggacaaccacggctacatctgcctgctcattcagggagccacaaaagaagatgctgggtggtatactgtgtcagccaagaatgaagcagggattgtgtcctgtactgccaggctggacgtttacagtgagtgccacttcatctcatttcattgcgtttactcattaaattatgaaaaattagacatctggacagcaaatcacattactctttataaacaactattgtgttttatttgtcaaaaaaattcatattgctctctctctctttctatttgtagtttctcgacattaatagtgaaccacaccaggagaacaaatacccaagtatcattcaggaactttgaattattagcaaaatatgcatgttgatttctcttacattggctagttagttgtggcttccttactcaagcatccttaggagttaacagtaggcaaaggcataaccatgtttttcacatgttcttgttactgtgttctgcaaatgactgccttttaacatttcttcctatattctatcgcagtgtcctaatgcactctaaacgtgtgttccattgatcctggaatgcgtacttttgtggcttagtgcttttctcattaatatatcttaagcagccagcagtagacttgtgtttgtatatttgtgtacatgcatcccaaatttaaagaaaattattcctattgaatttacagtctagtacaatcagcattatgttatccattgacataaaaaaaacactagaaaaaaattaagaatttatttaagaatttatttcagattttgcctcttcttgaaataactatgtgagggtcatcaagaaatgtgtggcctcaaccttccctactgtacgattcctttcagttgattagtgttaaagcatccacatccagcagaattcctaagtgctataattattttagagaaaatattttttaaaaggagaggggggatgagaattaggaagcttatcagctattccaaaggattccctgtgctgcagtgtttacttaaaaaaaaaaagataaactacacttgacctttgtaatctagctgctttattcccactatcctgtatagacagtaaatctgcaacatgtgagtaaaatgcaaaagtgttcctaaattttccatgtttctaccatggatgtgttcaggtgccttgcatctatctagacattctgtatttatttgaaatatctaaag

SEQ ID NO: 363253 - DNA, 1751 bp, Homo sapiens
cctgagtcacccggcgggcgaggtataaagcccgatacctgccccgcgcccggtccgcggagcccgctgcagctcccgctcgctccggacgcggaatcgggcagcagcgggaggcggcccggagagccgagggaccctctgaagctccagcaactccagaaccaaatccgactggagcaggaggccggcgctcggcagcctccgccagccccgcgcagcgcgccgccctcgcccccccttcccgccgccgcccgccttccccgagctcgcggcctgcacgccgcccgcgtccccggagcccatgagcgcgctggcctcccgctccgcccccgccatgcagtcctccggctccttcaactacgcgcgccccaagcagttcatcgccgcgcagaacctcgggcccgcgtcgggccacggcacgccggcctccagccccagctcgtccagcctcccgtcgcccatgtccccgacgccgaggcagttcggccgcgcccccgtgccgcccttcgcgcagcccttcggcgctgagcccgaggccccgtggggctcctcctcgccgtcgccccgcgccccgccacccccggtcttcagccccacggctgccttcccggtgcccgacgtgttcccactgccgccgccaccaccgccgctcccgagcccgggacaggcgtcccactgctcgtcgcctgccacccgcttcggccacggccagacgcccgcggccttcctcagcgctctgctgccctcgcagccgccgccggcggccgtcaacgccctggggctgcccaagggtgtcacccccgcaggatttccaaagaaggccagtagaactgctagaatagcctccgatgaggaaattcaaggcacaaaggatgctgttattcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggtaccatgttgctctggacttcttagggtaacatttattctgtcccccttttccatcttccttatggatactgttcttgggatgagttctggtgcaactacattcactctaattttctttcttgctacctctttagcaagagcacgtgaaaatccaactaatcctcctttactggcactgtaaacggactggccagagttgccttttaagccaacaatgcttcctacattaacaatagaccctccctgttgttgaatcatagtcctcatggcagctttacaggtcagcatggaacccaagaggttagtatgaagctgagataccatatcttcagtttttgttcttactaaaagaccatccctgttaataccagctgcatttaccaagaaatttactcgacctaaatgtttctccatctcttcaaatgtattttgaacatcatgttctttagcaacatcacagctaaatgccaaatgatctccgccgaggtcaccggcggcggctttggccccttccaggtttctggcaatgaccgccagtcggtagcctttccgggccattaactgggccacagctctgccaatgcctcgggagcctccaaaaacagcacacactttgtccatctcggagtcacaaactcggaggaaagaaggtagagagtgggagcccccctccaggttccctcaggcttttaaacaaccgcggttccaaa

SEQ ID NO: 363254 - DNA, 418 bp, Homo sapiens
attccccaacctgatagccctccgcgacgcattacgcaccgcggacagctggagaggccgaggcgctctcgctttgatttcggcgcctccgccctcgcggggagagattggctgcggccgcgggacggggtagtgagcgcgtcacttcctgccgctgccaggcgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcgggtgagcagccgcggacgcgaggaaaccggggcgtgcgcagagggacgaactcacgccgtgcttgcttccgtgtgccgtgc

SEQ ID NO: 363255 - DNA, 2096 bp, Homo sapiens
attccccaacctgatagccctccgcgacgcattacgcaccgcggacagctggagaggccgaggcgctctcgctttgatttcggcgcctccgccctcgcggggagagattggctgcggccgcgggacggggtagtgagcgcgtcacttcctgccgctgccaggcgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctgttgcaaaatttaccaaatttgttgattacctcttttattaaagaaatgttggggagagggtaatatattgtgacaatttttgcaacttacagggaataggacaggtcattagggtgtatttcccaggtttccaattgagaatctaaaccaagagaagtgagacaaaccatctaatatctgtatcatgctattaataggctgtgatgttgagtttctcacttactctttctgaggtccagggtccttatatgaagagattcatatatatgaagagattcgtctagagcagtggttgtcaaagtgtggtctgggggggcctcaagagcctttcaagggtattctaggtcaaagctgtttttataacactaagacatcatttcactatttatagcttttccttttttttatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtgatattgtaataggctgaatgcaaaagcagatacaagattccagctttcgtctgtcatcagacattgaagagatttggagaaatgtaaagcagcagtactcttctcactaatttttgttgtggttagttagaaaaatggttatttttagtgggttttaatatgtgaaaaaaataaaattagctatttgccaaaaatgtttttatgtgtttatatatacttggttcttgttacttgcaaatgattaataaaaattttaagaaatt

SEQ ID NO: 363256 - DNA, 1981 bp, Homo sapiens
agattacagacatgagccacatgcccagctgatttgttgttttaaagcaggaaccaattacagttctttttgttttacactagaattttctagccaagaatttcatggcaaaatatatacacacacacacacgtatatacatttatatatatacatatatatacacacacatgtgtatatataaaaaaatagaattaatctaatttttgtttctgttttccagtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctgttgcaaaatttaccaaatttgttgattacctcttttattaaagaaatgttggggagagggtaatatattgtgacaatttttgcaacttacagggaataggacaggtcattagggtgtatttcccaggtttccaattgagaatctaaaccaagagaagtgagacaaaccatctaatatctgtatcatgctattaataggctgtgatgttgagtttctcacttactctttctgaggtccagggtccttatatgaagagattcatatatatgaagagattcgtctagagcagtggttgtcaaagtgtggtctgggggggcctcaagagcctttcaagggtattctaggtcaaagctgtttttataacactaagacatcatttcactatttatagcttttccttttttttatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtgatattgtaataggctgaatgcaaaagcagatacaagattccagctttcgtctgtcatcagacattgaagagatttggagaaatgtaaagcagcagtactcttctcactaatttttgttgtggttagttagaaaaatggttatttttagtgggttttaatatgtgaaaaaaataaaattagctatttgccaaaaatgtttttatgtgtttatatatacttggttcttgttacttgcaaatgattaataaaaattttaagaaatt

SEQ ID NO: 363257 - DNA, 2043 bp, Homo sapiens
attccccaacctgatagccctccgcgacgcattacgcaccgcggacagctggagaggccgaggcgctctcgctttgatttcggcgcctccgccctcgcggggagagattggctgcggccgcgggacggggtagtgagcgcgtcacttcctgccgctgccaggcgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctgttgcaaaatttaccaaatttgttgattacctcttttattaaagaaatgttggggagagggtaatatattgtgacaatttttgcaacttacagggaataggacaggtcattagggtgtatttcccaggtttccaattgagaatctaaaccaagagaagtgagacaaaccatctaatatctgtatcatgctattaataggctgtgatgttgagtttctcacttactctttctgaggtccagggtccttatatgaagagattcatatatatgaagagattcgtctagagcagtggttgtcaaagtgtggtctgggggggcctcaagagcctttcaagggtattctaggtcaaagctgtttttataacactaagacatcatttcactatttatagcttttccttttttttatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtatagcggtggtatcctgataccaccaagggaaggcgatagttgggattctaaggggctctgaggtttctggaatggctaacagcctgaatactggtgtcattaagcatgtaggaatacggtggtatggtggtatggggtatagggtggtatagctccattattgattggcttcccggtactggtgcaccaggtcactgacatctgtacctt

SEQ ID NO: 363258 - DNA, 233 bp, Homo sapiens
aagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagtaagagaattatatataatcatgcatttttctttcaggagagcaagtggtctggaggaatattacagtatgtt

SEQ ID NO: 363259 - DNA, 2386 bp, Homo sapiens
attccccaacctgatagccctccgcgacgcattacgcaccgcggacagctggagaggccgaggcgctctcgctttgatttcggcgcctccgccctcgcggggagagattggctgcggccgcgggacggggtagtgagcgcgtcacttcctgccgctgccaggcgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctgttgcaaaatttaccaaatttgttgattacctcttttattaaagaaatgttggggagagggtaatatattgtgacaatttttgcaacttacagggaataggacaggtcattagggtgtatttcccaggtttccaattgagaatctaaaccaagagaagtgagacaaaccatctaatatctgtatcatgctattaataggctgtgatgttgagtttctcacttactctttctgaggtccagggtccttatatgaagagattcatatatatgaagagattcgtctagagcagtggttgtcaaagtgtggtctgggggggcctcaagagcctttcaagggtattctaggtcaaagctgtttttataacactaagacatcatttcactatttatagcttttccttttttttatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtgatattgtaataggctgaatgcaaaagcagatacaagattccagctttcgtctgtcatcagacattgaagagatttggagaaatgtaaagcagcagtactcttctcactaatttttgttgtggttagttagaaaaatggttatttttagtgggttttaatatgtgaaaaaaataaaattagctatttgccaaaaatgtttttatgtgtttatatatacttggttcttgttacttgcaaatgattaataaaaattttaagaaattaaaaacaaaaaaacacaaaaaacaaaaaaaaacaaacaacaaacaagaagaaaaagaaagagagaagaaaaaagaaataaaaaaaagagagaagagaagaggcaccgaaaagagacagaacaacaagaaagaaagcccaggagtaaaacataagcaaacagaggagagagacataagggcgaaaaagaggtagacaaacaagcgtaatagaggaacggacaagaaaaggaaataggagagcagacagcaaagaaagaaagaagagaggggagaaggagaaagagacagct

SEQ ID NO: 363260 - DNA, 231 bp, Homo sapiens
gtagttaatgttacaaaagaaaacacttattctttcacatagctcttatacagactgaaaagtctaggaagaatgatgccaggaagatgctttgcatgattatttaaaaagatgtcattattaagtaaaaattgtaaagtgcagaagagtatatagtacactattttgtgtgagaaaaagcaagattacaaatataatcatgtatcctctgatattttcaagaagaaagaa

SEQ ID NO: 363261 - DNA, 824 bp, Homo sapiens
aatacaaaagattagccgagtgtggtgtctcgtgcctgtgtgtgtgtgtgtatgtgcatgtgtatatatgtgtacacacacacacacacgttgttctgccttgcacagcccagtgacaaccttggccccacccttgtccctctgatccattcaagtcaggaatcttggttgtgttttggaggctgtggggtcccaggttcatccatgatacaggttggtcgccaactggtagtgatgtgaatggcgaactagccatcctttagggaccagctcaaatgctgttacctcccagaaatcttccctggttcattctggccacctctgtctcaacagccctgccttgcccgttgttctccctgacatggtccccaaggggtctttctgacatccagagctgaccccatctctgctgacagcatcccatgggtccctagcatgttaggacaggtccagctgccaccatctggccttccagggctcttccccaagctgtgtggcctcatggacctccaccccaccccatctcctcccttctcttgctgccatcctcgggatgggacgcatccctcatcgtgccacgttctctcaagcctccctggctgtgcacgtgtcctttctttttcccttagaacttccctgtccttggccaggcacagtggctcacgcccgtaatcccagcactttgggaggccgagaagggcagatcatgaggtcaggatttcaagaccagcctggccaacatggtgaaaccccatctctactaaagatacaaaaaattacccaggtgtggtggcgcacgcctgtaatcccagctacttgggagg

SEQ ID NO: 363262 - DNA, 374 bp, Homo sapiens
taacaggacatttcttttccaacccttcttttcttttcttttttcatcaatctgaagtatcctgggacgctctttggcctggcacatgggtaggtaggcatattgtcaaagattgagctgcagtttttcaatttgtgacttccctgataactacttcctctagaagtccccagaaatgaaaatgggagtgtgtgtccaggcacaattgcttctcccagtcttcctggggatgttccaatcttgtcaaccagttttcagttttgtttcagagtattgactcaagtaattaaatcatcaataatattagacttccctttttcctttttaatttttctttctctattattctttttcttcactatccaccccaaccc

SEQ ID NO: 363263 - DNA, 210 bp, Homo sapiens
tggccggcaggcggcccatggactattactcagtcccaaaaacggatggacacagggcagcagggccgacaggcggcccatgaactattagccatgaaaacggatcaaaaacagatggacatggggcagcgcggctggcagacagcccataaactattactcagccccaaaaacgaatggacatggggcagatggactattttactcagc

SEQ ID NO: 363264 - DNA, 780 bp, Homo sapiens
ctttgatggagtcttccaagcgcggtttctgggtcaaaggacagatccatgtgcttggtccgccttggtgtccagtttgcggttttagctgcggggcgtctctgttgaacacatattgtggctttagtaggatctggccagtgagttgccataactgacgtttcccctaccctccctttagagaagagagaacagagctgaggcctgggaacctaacccctcagtgttactgatttctttcatggaagcccttgtgggaggtgtcatcgtaaagctaacatcctctctctgtttggaatttcagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaaggtaagcgggtgccttgttgagagggtcagcaggacacggggcctgtccctgagatcctgtggagagccgggaggaattgcaccctcagtgcagggcactctatgctgttgctggaagttctccttccaccatctgatcagattctgggctaggactctgtgatgtctaagaaagcaaatggctgcagcaagtgcgggaaatgtcacagggaggaaacaggatctgggctgggagcagtggtgtatgcctggaatcccagcacctcaggaggccaaggcaggaggatcccttgaggccaacctgggcaacacaacaagaccctgtctctattcta

SEQ ID NO: 363265 - DNA, 2862 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363266 - DNA, 3090 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtgagacagggtttcaccatgttgatcaggatggtctcgatctcctgaccttgtgatccgcccacctcaccctcccaaagtgctgtgattacaggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagagtttttaatataatcacagagttgtgcagccatcaccatcatcaagtttataccattttcttcactcctgaaagaaatcctgtaccaggcgggacacagtggctcacacctgtaatcccagcactttgggaagccgaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363267 - DNA, 2308 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363268 - DNA, 2509 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363269 - DNA, 1986 bp, Homo sapiens
ctggacatggttgcacacacctgtaatcacagctactcgggaggttgaggcaggagaatcgcttgaaccagggagttggaggttgcagtgagtggagatcacaccattgccctgcagcctaagcaacagagcaagattctgtctcaaaaagaaaaaaaaaaaagaaaccaaaacaaaacaaaaaacaactgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363270 - DNA, 1897 bp, Homo sapiens
gcacaggttctgtgccacggggtccttagaatacgtgtgtgtgatggggaaggcgcagggcgtgtcttaggcacactccatggtcccctccacccttcacgcctggcccagagctggtcgtgccatcagggccctcaggagccaccgctgggtttccctctttagtttagggttcagtcccaggaccgaactaggagatggtgccatccccgccatcctccacagaagtgtcaggagcagggaccacctgtcattctcccaccctgcccatcacaggctgacggccgcttctgcaacgccctttttacaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363271 - DNA, 1983 bp, Homo sapiens
gcacaggttctgtgccacggggtccttagaatacgtgtgtgtgatggggaaggcgcagggcgtgtcttaggcacactccatggtcccctccacccttcacgcctggcccagagctggtcgtgccatcagggccctcaggagccaccgctgggtttccctctttagtttagggttcagtcccaggaccgaactaggagatggtgccatccccgccatcctccacagaagtgtcaggagcagggaccacctgtcattctcccaccctgcccatcacaggctgacggccgcttctgcaacgccctttttacaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgtgagatcttagttaacgtttctttccttgtcctctttggagctgttgtttttacccttcacctcattctgctgtctgtcctctaggagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363272 - DNA, 2038 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaaggtaagcgggtgccttgttgagagggtcagcaggacacggggcctgtccctgagatcctgtggagagccgggaggaattgcaccctcagtgcagggcactctatgctgttgctggaagttctccttccaccatctgatcagattctgggctaggactctgtgatgtctaagaaagcaaatggctgcagcaagtgcgggaaatgtcacagggaggaaacaggatctgggctgggagcagtggtgtatgcctggaatcccagcacctcaggaggccaaggcaggaggatcccttgaggccaacctgggcaacacaacaagaccctgtctctattcta

SEQ ID NO: 363273 - DNA, 2168 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaaggtaagcgggtgccttgttgagagggtcagcaggacacggggcctgtccctgagatcctgtggagagccgggaggaattgcaccctcagtgcagggcactctatgctgttgctggaagttctccttccaccatctgatcagattctgggctaggactctgtgatgtctaagaaagcaaatggctgcagcaagtgcgggaaatgtcacagggaggaaacaggatctgggctgggagcagtggtgtatgcctggaatcccagcacctcaggagtgggggcgctgttaggaggcgatcgttacggaggcgctgttacggaggcgctcgttacggaagcgctcgttacggaggcgctcgttacggaagggtgtaacggaggcgctttttacggaagcgctcgttacggagggctagtataggagggtgaaaggaggcgtgtaaggaggcgctcgttacggacgggaccg

SEQ ID NO: 363274 - DNA, 1366 bp, Homo sapiens
tgatctgcccgcctcggcctcccaaagtgcagggattacaggcgtgagccaccgcacccagctgagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363275 - DNA, 1570 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtgtggacgctgcagacagcggctcttcacttcttttgggtcctggagctgttagagattctgatggaagttatgaattattcttcccgtaattcatagacacacaaacacacttctaagtcctgtgtactatttcagaggggccacagactctgggggagccacacagatgccctggtgcaggttcagaacccaggtttcacataagatagagacgtcttcatcagagatagcgcgctgtgtttcttacctcgcccttctgttgaggagtgaaatccctcagtattaatgccgcatggccttctgggattcgtatcgtcgtcctgggttgtgagtgccatcagtagtgtagtgtagcaggtctggcactctggggggg

SEQ ID NO: 363276 - DNA, 422 bp, Homo sapiens
gtgtgatggttttactgcccaagagagagcccacactcatgatctgtgactaggcatagagccttgtcctgagccgaggtggctgccacccagcacagctcgccggtgcatctttgctggagtcttccaagcggggtttctgggtcaaagggcagattcctgtgcctggtccgccttggtgtttcgggaggtctcgggtgacagagggtgagtgacagcattctactgattgggtctcgccctcagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactgga

SEQ ID NO: 363277 - DNA, 2953 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtgagacagggtttcaccatgttgatcaggatggtctcgatctcctgaccttgtgatccgcccacctcaccctcccaaagtgctgtgattacaggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363278 - DNA, 2821 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363279 - DNA, 2542 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363280 - DNA, 2458 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctgagtaccggctggtcatagtgggccacagcctcgggggcggggcggccgccctgctggccaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgaaccccagcactttgggaggccgaggtgggcagatcactaggtcaagagatcgagaccatcctggccaacacagtgaaaccccgtctctactaaaaataca

SEQ ID NO: 363281 - DNA, 2734 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcgagtacggcagagcttttctcaacctacttttcagacacagatctggtgcccagcgacattgcggcgggcctcgccctgcttcatcagcaacaggacaatatcaggaacaaccaagagcctgcccaggtggtctgccatgccccagggagctcccaggaagctgatctggatgcagaattagaaaactgccatcattacatgcagtttgcagcagcggcctatgggtggcccctctacatctacagaaaccccctcacggggctgtgcaggattggtggtgactgctgcagaagcagaaccacagactatgacttggtcggaggcgatcagctcaactgtcacttcggctccatcctgcacaccacagggctgcagtacagggacttcatccacgtcagcttccatgacaaggtttacgagctgccgtttttagtggctctggatcacaggaaagagtctgttgtggtcgctgtgagggggaccatgtctctgcaggatgtccttacggacctgtcagcggagagtgaggtgctggacgtggagtgtgaggtgcaggaccgcctggcacacaagggtatttctcaagctgccagatacgtttaccaacgactcatcaacgacgggattttgagccaagccttcagcattgctcctcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363282 - DNA, 1542 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcaccatgctcagagccgcctacccgcaggtcaggtgctacgccttctccccaccccgggggctgtggagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363283 - DNA, 1604 bp, Homo sapiens
ctttgatggagtcttccaagcgcggtttctgggtcaaaggacagatccatgtgcttggtccgccttggtgtccagtttgcggttttagctgcggggcgtctctgttgaacacatattgtggctttagtaggatctggccagtgagttgccataactgacgtttcccctaccctccctttagagaagagagaacagagctgaggcctgggaacctaacccctcagtgttactgatttctttcatggaagcccttgtgggaggtgtcatcgtaaagctaacatcctctctctgtttggaatttcagcaaagctctgcaggaatattctcagagcttcatcgtgtcactcgtcctggggaaggatgtgattcccaggctcagtgtgaccaacttggaagatctgaagagaagaatcttgcgagtggtcgcgcactgcaataaacccaagtacaagatcttgctgcacggtttgtggtacgaactgtttggaggaaaccccaacaacttgcccacggagctggacgggggcgaccaggaagtcctgacacagcctcttctgggggagcagagcctactgacgcgctggtccccggcctacagcttctccagcgactccccactggactcttctcccaagtacccccctctctaccctcccggcaggatcatccacctgcaggaggagggcgcctcggggcggtttggctgctgctctgctgctcactatagcgccaagtggtcacacgaagcggaattcagcaaaatactcataggtccgaagatgctcaccgaccacatgccagacatcctgatgcgggccttggacagcgtggtctccgacagagcggcctgcgtctcctgtccagcacaaggggtctccagtgtggacgtggcctgaccagggccactggaaactgtcccaggaacgatggactcacgcttttgtccttaaactgacttaccatccgaggagttcccatgacgccaaaacagcgaatgtccatcaacaggaatcggatgggaacagaattccatggtctcaatgacttaagtttatgggaagtcattgtggccataatggtagcagaagtagcgagcacgctcaggtgataggacgactcctgagacccagcgaccgtggagacagcctcgggaagccctggcccgtggatggatcccttggctgtctgaggactgctccagaagtgcgggaatccagggcccacccagaagaccgtgaacagttccttagcctcccacccccaaggcagctcttttcatccaactcagtttacaggcgtggtttgtttttcaaactgggcttcctggatgtacaaatggaactgtggtgagggtgcgggctggggttttctcctgggcgtcaccaagggcagccctgggctctggctggggatgaagacgaaacccgatcgggaaagtaagtggagcccccggccccgccgagccacagccccccaactgcctattcccactgcccagttgtttgtccacatcaggagttgctgattgaattcttgctactcttctggctctggggtcggccagtggattcaggagttgaaacaataaagcgcgcgtcacgata

SEQ ID NO: 363284 - DNA, 687 bp, Homo sapiens
atgcgcaggtccccgccctcgctgcgtttgcgcttgagcgccgataatttggtggcggcgtccggagggtgctggtttgttctcggtgaacggcgcgcggggtctctcctgagtgcgagctacgggaccttcgccatgccggggatggtactcttcggccggcgctgggccatcgccagcgacgacttggtcttcccagggttcttcgagctggtcgtgcgagtgctgtggtggattggcattctgacgttgtatctcatgcacagaggaaagctggactgtgctggtggagccttgctcagcagttacttgatcgtcctcatgattctcctggcagttgtcatatgtactgtgtcagccatcatgtgtgtcagcatgagaggaacgatttgtaaccctggaccgcggaagtctatgtctaagctgctttacatccgcctggcgctgttttttccagagatggtctgggcctctctgggggctgcctgggtggcagatggtgttcagtgcgacaggacagttgtaaacggcatcatcgcaaccgtcgtggtcagttggatcatcatcgctgccacagtggtttccattatcattgtctttgaccctcttggggggaaaatggctccatattctctggggtcggccagtggattcaggagttgaaacaataaagcgcgcgtcacgata

SEQ ID NO: 363285 - DNA, 486 bp, Homo sapiens
aactcctgggctcaagtgtcctcctgccttggcctccctaagtgctgggattacaagcgtgcgccaccacacctggcacctgcttcacgtcaggcgctgtgcaaggtgccaggagcacagccatgcacgatggacgtggctgctgattctgcagtctcagatcccaggagagactcacacatcagtgcacagcgtcatcccatctttgagtctctgctgggcctgccttgtctgaggattaacggccaccttctttgtctgtgtttttagggtatttctcaagctgccagatacgtttaccaacgactcatcaacgacgggattttgagccaagccttcagcattgctcctgtgagatcttagttaacgtttctttccttgtcctctttggagctgttgtttttacccttcacctcattctgctgtctgtcctctaggagtaccggctggtcatagtgggccacagcctcgggggcggggcggccg

SEQ ID NO: 363286 - DNA, 4044 bp, Homo sapiens
cgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggtgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaaaagaacacataaacttatagaaactagcaacatgatacatagcaaaatcttggggggtgtttttaggggggggggaaaatgggtctgaaagtggactggtgcgctaaagtttttctggacacggtttttgtgcaagggggagaaaaggcggccccataggggcgcgatgaatgcaacgcgggacgt

SEQ ID NO: 363287 - DNA, 4677 bp, Homo sapiens
cgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcactgttgtgtgcttgagttgctggacagggatgactcagctaagaagacagcgagagaacctcttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttgagggccagaggctggatcctgggatccagaggggagggacagagctgaatgcctcacctggggtcatcctggacaaccgtgctctgggcaaagctaaggaaggcggcacagaagttcatgcacacagagggattccagccgtcacggtcattctggagcaggcagaggaggaggcagaagatgggcagtgggggtggtgggaggagagaaggcaggctgttgccctggatgctagacctgtggtcttggtgtttggggatacgggtgggagctgcaacatcgttcccttaccctgacatattcaaacatcttcatggtaggaaaggtcttgagggaagagacaaaaccgtctgggttacggaagccagcaacaacattcgggacccctgggaggaatgactgagcccaccatttcaggagcttgtgtctgacaggaaaagcaagggatcagtgggacccctcgtgcaccctccattctgccttcaccctcctccccaagtccctttcccagccttcaagcctaagctctcgccctgcccaccccgatcctgaacctgtagaaactcctccattggccagggctgtgcatctccttggaggtcttgagctccacatagcaggttgggggctgtgtggatggggcttgggggtctgtgcagtctacctcccctgagaagagcagagggtggcttcccaggcggctgcgtagcacagagcagaaggccacgttggtgtta

SEQ ID NO: 363288 - DNA, 4996 bp, Homo sapiens
cgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaaggttagttttagtttttgagtggggtgtaggagaagtcatgtccttctcctaaggaacagagatggacatgacaaggttgaccttgttggcttgctcctcagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggtgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcactgttgtgtgcttgagttgctggacagggatgactcagctaagaagacagcgagagaacctcttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttgagggccagaggctggatcctgggatccagaggggagggacagagctgaatgcctcacctggggtcatcctggacaaccgtgctctgggcaaagctaaggaaggcggcacagaagttcatgcacacagagggattccagccgtcacggtcattctggagcaggcagaggaggaggcagaagatgggcagtgggggtggtgggaggagagaaggcaggctgttgccctggatgctagacctgtggtcttggtgtttggggatacgggtgggagctgcaacatcgttcccttaccctgacatattcaaacatcttcatggtaggaaaggtcttgagggaagagacaaaaccgtctgggttacggaagccagcaacaacattcgggacccctgggaggaatgactgagcccaccatttcaggagcttgtgtctgacaggaaaagcaagggatcagtgggacccctcgtgcaccctccattctgccttcaccctcctccccaagtccctttcccagccttcaagcctaagctctcgccctgcccaccccgatcctgaacctgtagaaactcctccattggccagggctgtgcatctccttggaggtcttgagctccacatagcaggttgggggctgtgtggatggggcttgggggtctgtgcagtctacctcccctgagaagagcagagggtggcttcccaggcggctgcgtagcacagagcagaaggccacgttggtgtta

SEQ ID NO: 363289 - DNA, 1808 bp, Homo sapiens
  misc_feature (1791)..(1791): n is a, c, g, or t
cgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattggggcggatgaagcagtcagaagatcctatgtggaatagccactggatacccggcccgatgcccctggagcacaactatacaccagggaacacagtccaagaacccaagggggagcctcaaaaaggaagcaggagcacccaaggaagaccttcccatcaaaaagcggcacctaaccagcagtaaggaaggcaaaaacggcaagcacaggacaaaagcaaccaagactatggagacaagcgcaccacactatagggggcgcggaaagaccacagataaacaggcagacggagacagcagacaagatcacnaccgaccacagacataa

SEQ ID NO: 363290 - DNA, 355 bp, Homo sapiens
gtcagagatgctagggaggcccttctcctccagaggggcacgtagaggcagggaggggcagtggtctgggagtttcctccagcctgagggagaccatgaagtggtggggttgtagtgagggggctcccccagcctaagggagactgtgaagtggaggttgtagtaagagggcttccacagcctgagggaggcttctgggggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagc

SEQ ID NO: 363291 - DNA, 4895 bp, Homo sapiens
cgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggtgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatgcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcactgttgtgtgcttgagttgctggacagggatgactcagctaagaagacagcgagagaacctcttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttgagggccagaggctggatcctgggatccagaggggagggacagagctgaatgcctcacctggggtcatcctggacaaccgtgctctgggcaaagctaaggaaggcggcacagaagttcatgcacacagagggattccagccgtcacggtcattctggagcaggcagaggaggaggcagaagatgggcagtgggggtggtgggaggagagaaggcaggctgttgccctggatgctagacctgtggtcttggtgtttggggatacgggtgggagctgcaacatcgttcccttaccctgacatattcaaacatcttcatggtaggaaaggtcttgagggaagagacaaaaccgtctgggttacggaagccagcaacaacattcgggacccctgggaggaatgactgagcccaccatttcaggagcttgtgtctgacaggaaaagcaagggatcagtgggacccctcgtgcaccctccattctgccttcaccctcctccccaagtccctttcccagccttcaagcctaagctctcgccctgcccaccccgatcctgaacctgtagaaactcctccattggccagggctgtgcatctccttggaggtcttgagctccacatagcaggttgggggctgtgtggatggggcttgggggtctgtgcagtctacctcccctgagaagagcagagggtggcttcccaggcggctgcgtagcacagagcagaaggccacgttggtgtta

SEQ ID NO: 363292 - DNA, 4989 bp, Homo sapiens
cgcccgttccggggcggggcttacttcgcagcgactacttgccgcacttccgggctgccaggcagctgctgtggctccaggatgatggagacagagcgacttgtgctaccccctccagatcccctggacctaccccttcgggccgtggagctcggatgcacggggcactgggagctgctgaacttgcctggagctccagagagtagccttccccatggcctccctccttgtgccccagatctgcagcaagaagcagaacagttgtttctgtcatccccagcctggctgcctctgcatggtgtggagcactcagcccgaaaatggcagaggaagacggatccctggtctcttttggctgtcctgggagccccagtcccatccgacctacaggcccaaagacacccaaccacaggccagatactgggttacaaagaggtcttgctggagaacacaaatctctcggctacaacctccttgtctcttcgccggcctccagggccagcctcccagtccttatggggaaatccaactcggtatcccttctggccaggggggatggatgaacccaccataacagatctgaacacacgggaggaggctgaggaggagatagactttgagaaagatcttcttactattccacctggtttcaagaaaggcatggactttgcaccaaaagattgtccaactccagctcctggactactaagccttagctgtctgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggaagcgtccacagctgtatccaccccagaggccccagagcctccatctcaggagcagtgggccatccctgtggacgccacctcccctgttggtgatttctatcgcctcattccccagccagccttccagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacgcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcgctccatgctgtacagtggctcagatgttattcgggacctggagtgggtcatctttgatgaggttcactatatcaacgatgtcgagcgtggggtcgtgtgggaggaggtgcttatcatgctacctgaccacgtttctatcatccttctgagtgccaccgtccccaacgcccttgagtttgctgactggattgggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtactatgcagctgtggaggccaagaaggagagaatgagcaaacacgcccagacctttggggccaagcagcccacacatcaggggggccctgcacaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtcctgcacatgtcagagctcctgaatcgcggcctgggtgtgcaccatagcggcatcctgcccatcctcaaggagatcgtggagatgctcttcagccgtggcctggtcaaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggcccatgaacaggccctggctgaactgaccaagaggctgggagctttggaggagcctgacatgactggccaactggtcgacctgcctgaatattacagctggggggaggaactgacagagacccagcacatgatccagcgacgcatcatggagtctgtgaacgggctgaagtctctctcagcaggaagggtggtggttgtgaagaatcaggagcatcacaacgcattgggagtgatcctacaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaagggccttgtgaccacaccgtggtcaagctccagccaggagatatggctgccatcaccaccaaggtgctccgggtgaatggggagaagatcttggaggacttcagcaagaggcagcagccaaaattcaagaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccagtacctgaagctgcgggagcgaatgcagatacagaaggagatggagcggctgcgcttcctactgtcggatcagtcattgctgctgcttcctgagtaccatcagcgagtagaggtgctccgaaccctgggttacgtggacgaggtgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcactgttgtgtgcttgagttgctggacagggatgactcagctaagaagacagcgagagaacctcttagaaatatgcttttattatctgcacacagagatatgactgcctccctctaaagcattactatttgggagagggagtcttggggggtgatgggaggtcctgagtcatagcttccacataccatatgggcaggaaggcgtaaggtgcatcttggtgtacagacacggtgactgggccgccaggctcccaagagaagagatgaacgagcctggggggcagatggaggcatcagttgagggccagaggctggatcctgggatccagaggggagggacagagctgaatgcctcacctggggtcatcctggacaaccgtgctctgggcaaagctaaggaaggcggcacagaagttcatgcacacagagggattccagccgtcacggtcattctggagcaggcagaggaggaggcagaagatgggcagtgggggtggtgggaggagagaaggcaggctgttgccctggatgctagacctgtggtcttggtgtttggggatacgggtgggagctgcaacatcgttcccttaccctgacatattcaaacatcttcatggtaggaaaggtcttgagggaagagacaaaaccgtctgggttacggaagccagcaacaacattcgggacccctgggaggaatgactgagcccaccatttcaggagcttgtgtctgacaggaaaagcaagggatcagtgggacccctcgtgcaccctccattctgccttcaccctcctccccaagtccctttcccagccttcaagcctaagctctcgccctgcccaccccgatcctgaacctgtagaaactcctccattggccagggctgtgcatctccttggaggtcttgagctccacatagcaggttgggggctgtgtggatggggcttgggggtctgtgcagtctacctcccctgagaagagcagagggtggcttcccaggcggctgcgtagcacagagcagaaggccacgttggtgtta

SEQ ID NO: 363293 - DNA, 7165 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaa

SEQ ID NO: 363294 - DNA, 7069 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaa

SEQ ID NO: 363295 - DNA, 6893 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaa

SEQ ID NO: 363296 - DNA, 5239 bp, Homo sapiens
tttaaattctagatatttactgtttctcttagcagtgtgaggttaatgatgttatacctaaaattttttgatctctaacagtgctgctgatactactttttgttttttaaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaa

SEQ ID NO: 363297 - DNA, 1879 bp, Homo sapiens
aactgggacttcaggtatgcaccaccacacctagctaatttttctgtttttgtagagatggaggtttcaccagtgttgcccaggctggccttaaactcttgggctcaagtgatctacccatcttggcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaa

SEQ ID NO: 363298 - DNA, 433 bp, Homo sapiens
gctaaacaatcctaattgccttccagatctggagttttgatctccttttgccacttcatgaattgaggggccacaacggctgtgtgcgctgctctgccttctctgtggacagtaccctgctggcaacgggagatgacaatggagaaatcagggtaggctgtttgctgacatgagagcactgctcttcttgtagcttgggctagcactgttcacagtggggacctttgttcacgggccagggaagcatagtcctgaagttgtggttggatgaggcattctttttgtttcttgtgcacattgtattcacagctgcactccactgcagaaacggattcattttagagttagagtgaagcattccctgtatatgtgaggaagcaagtgctctagtcatttgtagttcattctctgccattagcttgagaatgattca

SEQ ID NO: 363299 - DNA, 427 bp, Homo sapiens
ctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggatgtaagtaggttaggagagaaaccaaagggagtggtgcgctaactatatcattatttttcaggtggtgaatacgatcactccaggaggatttaactactttcgaaagggctggaacttttaataagcattcttacttattgaaaagttctagagaagtaagcataggagaaaatgattgtattttcaaagaatccatataaatagatgcctgtaaggcatttggacaaattatcctaagtattcagtactaagtgcttgacttactgtaatttagtatag

SEQ ID NO: 363300 - DNA, 639 bp, Homo sapiens
gcagcctgtcaggccaagtgggtgaaacaagaccagtgggcccaagcaaaacttgggcaaaggcgccaccggccacagaagtttctggccagaaaatcaacaccccaaagatcctgtaacattttcattgatatttacaaacatgtaacagtgaatagttctctagttatgtgaaggcatacacattctgacagaaattctgattttgggagtagctttgccaaggttcctttctgttttgcaaaatgacaatgattaaactcacttaaagatttttattgaatgatgaccagtagttaagcagtttattataaaaaatattttattgttacttgtgcaggtgttcaaagctgaaacaggagagaaacttctagaaatcaaggctcatgaggatgaagtgctttgttgtgcattctctacagatgacagatttatagcaacctgctcagtggataaaaaagtgaaggtaggaaaatcttttcctcttgagttgtaatcacaacagaattcattttatttttccatgatcatgagaccagagtaagtagagttaaaggactctcacctgttgatctactaacctgattcattgtaaattaacactatctgaaaattctttacttttttttaaagagacag

SEQ ID NO: 363301 - DNA, 7036 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaa

SEQ ID NO: 363302 - DNA, 7198 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaacaaaaaaaa

SEQ ID NO: 363303 - DNA, 3861 bp, Homo sapiens
aagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgaggtattcagtgctagtcttcagaatctttctgtacagaattaaataaaactaattatatgtctggcattgtgcacttctatttttatttatttttatttttgaaatggggtcttgctgtgtcacccacgctgagtacagtgacacgatcacagccgactgcagccttgaccttctgagctcaagtgattttcccacttaagcctcctgagtagctgggactaaaggtgtacgtcaccatgcccgactaattttttttttttgtagagatggggtcccctgtgttgcccaggctggtctcaaactcctgggtttaagcgattgtccgg

SEQ ID NO: 363304 - DNA, 806 bp, Homo sapiens
cggaacagtgacttggccggggggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtggctcataaacctctctgatgagtcctgccagtgttttcttagatcccactgttgagacaatggagccacagaattctttcacctcttgttgtcagacaaatccaatagaacacaaggtcagaagggcctatacttctaaaggttgaaagattctttttcaaaagatgatctaagaaatgtaggaccagtagatgctcaagtatatcttgaagaaatgtcttggaatgaaggttggattttttttttctcttgacaacatttaaaaaaaaaaggaattttctataagaaaaaaaaactcatgtggatattgggaaatcttaaaaagaaataatagtgtggctttctatatatatgtggtaagtgtttctgtctggagtatttctgcttaattctaaactttatttattgactgatgtccccctatatga

SEQ ID NO: 363305 - DNA, 457 bp, Homo sapiens
aaaaagaaatggtatggggtaggggaggtggataggtaagtagaaggattagaacagggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363306 - DNA, 625 bp, Homo sapiens
cggaacagtgacttggccggggggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatggttcattgatgatgttacatagcccttgacccatgtgaactgatgacagaatagagccacacagcatgtgaagtgatttgacctgtagcaatctttgaaccagtgttttgtctacacctatcctcagaggctatccagctgttagatttcatttttaataattcagccaagagtgtggaacatttttctcttgagattttcaatagctagtctgaagatatgtttttgagagcttcaaatagtgttccagaagagaatgttagaatcgggaagaataagcatattagatacttaaaggaaagtatctgaaaaagaaaatagagaatataagcatataattttcagtttactaaagaatactgtttttaggaataatagtcatgaaa

SEQ ID NO: 363307 - DNA, 490 bp, Homo sapiens
tgattttgacaaaaaatttataagaaatgttatgttctagatttttcagtcagctaaagtcaggttactttaacactgctgtcaaaaatactagtctaagtttttaagtgataggtaagttagaattgtagtggccaggctggcgttgcctttttagcattcttcaaggttacaattaaagtatcatgttttacaattaagtgtcatgttttatgttttacagaagatgatctaagaaatgtaggaccagtagatgctcaagtatatcttgaagaaatgtcttggaatgaaggttggattttttttttctcttgacaacatttaaaaaaaaaaggaattttctataagaaaaaaaaactcatgtggatattgggaaatcttaaaaagaaataatagtgtggctttctatatatatgtggtaagtgtttctgtctggagtatttctgcttaattctaaactttatttattgactgatgtccccctatatga

SEQ ID NO: 363308 - DNA, 2421 bp, Homo sapiens
cggaacagtgacttggccggggggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcgggtcgctgtaacctccgtctcctgggggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363309 - DNA, 2390 bp, Homo sapiens
tgattttgacaaaaaatttataagaaatgttatgttctagatttttcagtcagctaaagtcaggttactttaacactgctgtcaaaaatactagtctaagtttttaagtgataggtaagttagaattgtagtggccaggctggcgttgcctttttagcattcttcaaggttacaattaaagtatcatgttttacaattaagtgtcatgttttatgttttacagaagatgatctaagaaatgtaggaccagtagatgctcaagtatatcttgaagaaatgtcttggaatgaagttacttctcagagacagtaaaatggaatgaccaatggatcagagattctttaagtcaaagggcacaagcatttcaacttcccaggaaaatgacacacttaaaatttccacgatcaggagcctaagtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcgggtcgctgtaacctccgtctcctgggggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363310 - DNA, 2440 bp, Homo sapiens
cggaacagtgacttggccggggggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcgggtcgctgtaacctccgtctcctgggttcaagtgattctccagcgggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363311 - DNA, 2357 bp, Homo sapiens
cggaacagtgacttggccggggggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcgggtcgctgtaacctccgtctcctgggggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagactttggagtttaaacatatatacacataagtttatttgtcgacgcggccgcgaat

SEQ ID NO: 363312 - DNA, 1404 bp, Homo sapiens
accatgcctggccagaagcttttttaaaaataatgacttggaagttggtgcattatttccccttttattttggagtgttgatataatattggggccaggcatggtggctcacatctgtaatcccagcactttgggagactaaggcaggcggatcacctttggtcaggagttcgagaccaccctggccagcatggtgaaaccccatatctactaaaaataatttttttaaaaattggccagtcacgttggtgtctgcctgtggtcccagctactcgggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363313 - DNA, 1448 bp, Homo sapiens
  misc_feature (13)..(13): n is a, c, g, or t
  misc_feature (17)..(17): n is a, c, g, or t
  misc_feature (29)..(29): n is a, c, g, or t
  misc_feature (34)..(34): n is a, c, g, or t
  misc_feature (36)..(36): n is a, c, g, or t
  misc_feature (44)..(44): n is a, c, g, or t
  misc_feature (49)..(49): n is a, c, g, or t
  misc_feature (55)..(55): n is a, c, g, or t
  misc_feature (62)..(62): n is a, c, g, or t
agggccctacttnatgnggctggaccacnttaantngaaaaacnaccgntggggnttctaantaaacgcgtacgcccgatacgggatgattctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccaggggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363314 - DNA, 1395 bp, Homo sapiens
cggaacagtgacttggccggggggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcgggtcgctgtaacctccgtctcctgggttcaagtgattctccagcctcagcctcccgaatagctgggattacacgtgcccaccaccatgcccagctaatttttgtatttttagtagagatggggttccac

SEQ ID NO: 363315 - DNA, 762 bp, Homo sapiens
  misc_feature (13)..(13): n is a, c, g, or t
  misc_feature (17)..(17): n is a, c, g, or t
  misc_feature (29)..(29): n is a, c, g, or t
  misc_feature (34)..(34): n is a, c, g, or t
  misc_feature (36)..(36): n is a, c, g, or t
  misc_feature (44)..(44): n is a, c, g, or t
  misc_feature (49)..(49): n is a, c, g, or t
  misc_feature (55)..(55): n is a, c, g, or t
  misc_feature (62)..(62): n is a, c, g, or t
agggccctacttnatgnggctggaccacnttaantngaaaaacnaccgntggggnttctaantaaacgcgtacgcccgatacgggatgattctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtggtaggtgcttgtgttgaggagccacagcacatcggcaactcttagaagcacactctgcagccattcctggggagcattttccagcatttgcaccaagtgttattgttgcctttattcctcccctccatcactgtttttaattatgccctattcttagcagtgactattgtgtatccattgagaagttaacaaaactactaggatgtggcttcttgtgaagccttgaaagctactttttataacatttgaaaaatgtttaattacacattactaactaatatgctttatatgtttaaaaactttttattaaaataaatatggattaacattttaattgta

SEQ ID NO: 363316 - DNA, 911 bp, Homo sapiens
  misc_feature (13)..(13): n is a, c, g, or t
  misc_feature (17)..(17): n is a, c, g, or t
  misc_feature (29)..(29): n is a, c, g, or t
  misc_feature (34)..(34): n is a, c, g, or t
  misc_feature (36)..(36): n is a, c, g, or t
  misc_feature (44)..(44): n is a, c, g, or t
  misc_feature (49)..(49): n is a, c, g, or t
  misc_feature (55)..(55): n is a, c, g, or t
  misc_feature (62)..(62): n is a, c, g, or t
agggccctacttnatgnggctggaccacnttaantngaaaaacnaccgntggggnttctaantaaacgcgtacgcccgatacgggatgattctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatggttattggattttttccccctctttttggtgtacatacttggaaggacgcatctgtcacaggaaaatttttgtgaagcactcatcttctgacttgcccatgaattccttgttttaagcagtcaaggcaaacagtgtgcttctcaaattttagcacgcgtaacagttgcttggagagcttggtgaaacagagattctggagtcctccctctgaagatttgagtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggttggattttttttttctcttgacaacatttaaaaaaaaaaggaattttctataagaaaaaaaaactcatgtggatattgggaaatcttaaaaagaaataatagtgtggctttctatatatatgtggtaagtgtttctgtctggagtatttctgcttaattctaaactttatttattgactgatgtccccctatatga

SEQ ID NO: 363317 - DNA, 418 bp, Homo sapiens
gttcattaattaaagtataaatatatatcgtgaaatacctaacacgttttccatacttgtcggtacacttatacctggaattcttggggcattttaaatgaaaatctgtgcttcctcaggtttgcattataatcatgatttactcgactaaatactaaagaatttacaagggcagtacttaattttttcttagatacatggcaaactgtgatgaattgtcattaatatttctattcagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatggtaagtcttttctttcagattttaaatcatgagggg

SEQ ID NO: 363318 - DNA, 2466 bp, Homo sapiens
  misc_feature (13)..(13): n is a, c, g, or t
  misc_feature (17)..(17): n is a, c, g, or t
  misc_feature (29)..(29): n is a, c, g, or t
  misc_feature (34)..(34): n is a, c, g, or t
  misc_feature (36)..(36): n is a, c, g, or t
  misc_feature (44)..(44): n is a, c, g, or t
  misc_feature (49)..(49): n is a, c, g, or t
  misc_feature (55)..(55): n is a, c, g, or t
  misc_feature (62)..(62): n is a, c, g, or t
agggccctacttnatgnggctggaccacnttaantngaaaaacnaccgntggggnttctaantaaacgcgtacgcccgatacgggatgattctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcgggtcgctgtaacctccgtctcctgggggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgctgaaatgaacttttataaagtattattgactatagccaactacagatggcatatgccttaaagatgcatttttctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363319 - DNA, 2473 bp, Homo sapiens
cggaacagtgacttggccggggggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagagagtatgacctgcagcggtgtgaagatgatctaagaaatgtaggaccagtagatgctcaagtatatcttgaagaaatgtcttggaatgaaggtgatcactctttttatctgagttgcagatgtggtggaaaatacagtgtttccaaggatgaagcggaagaagttagcctgatttcttgtgatacatgttcactaattatagaactccttcattataactaaaattgttcacaacttgaaatgctttaactgtggtattgagacatgatgagaagccgttgagctttgtccattcaaggaaatggattatttgtcagcccgattatttgcaaagaaaatatacaattatcaagcagagaccacctcagattaatagagaatgaatataattatttatttgtatttataatttatatttacaagttgtcacaaaaatagatttgattatatttggtgaattcccatctgagaactttattatgtcatttttttccatgacacaaaataagaattttcttaatatgagcatgtctcctcttttcagtgggtaacagtatcatcatattcctttatagttactaagtttctggtctaaccgataacgtttctagttgctaaagttatggggctgttgtacacctagaatctttgtgaataatgtgaggccagttcttccataaggaaggctggttatggatattcataaggttatttcaaagttaataaagacaaagtggcaactgtagaaagtgttgcctccaatcttggtccgtatttccaaagcttgtaaacactgccatcttcaaatttaaatgtaatttaggaaatggaagcttttaattttaatttcttttttctaagacagagtctcactctgtcgcgccagctggagtgcagtgccatgatctcgggtcgctgtaacctccgtctcctgggttcaagtgattctccagcctcagcctcccgaatagctgggattacacgtgcccaccaccatatctactaaaaataatttttttaaaaattggccagtcacgttggtgtctgcctgtggtcccagctactcgggaggctggggcacaagaatcacttgaacccaggaggcagagtgagccgaggttgtgccactgcactgcagcctgggctacagagagcaagactctgtctcaaaaaaaataaaataaaataaataaaaaaagatatagtattaatgcctgtatttatgaagacagggccattgcactgctgctatgtatttaatattttgtgtacagtaaaagtcagaactcatttaaagaactttaagggatcctttagaaacatttttacttaatttcaaatgagtgggctgagcatgtagactagcagctttttatcaaacctggcattgtcaggttgaacttataaatacgaatagttactactctgacttgtaaatgtagctgctaaagtatgaggtatatttaagaagaatagattagtttcattatacctataagaacaagaattcaaaagtgaggtagtcatccaggttccccctcccacaatatttttgtatcataaaatttagatgacttttttgggttacatttttatccatatattttgaactaacagaacttggcagaatgtgtgttgaatattctttacatttaacaattaaaaacaactaaaactgaatagcaaatagtttattggtaagtacacggtttcaacgggagtaataaattcacatgaaaaggagacaataatcaagtcaaaagaataaatgcttactaatcatcagaaaatctgtggccattagggctggcacgtaaaaatccaaaatcactcagaggccaaatctgtaaaatcaaaatgaggttgaagacaattagtgaaagtaatgttatagtatcatcatattcccttttgctatctgtcccttttctctatgccagataaacactttctccttactcatcaatcaagaataaaattttctacatcaaagtaagacttgagaaaataaacttatgtgtatatatgtttaaactccaaagtttgggacattcaaacaatgtacatgaaattatatgtgtgtggtgtgtgaataaatatgtatgaatataaaaaaa

SEQ ID NO: 363320 - DNA, 416 bp, Homo sapiens
ctgcatggctcagcagctgagacggggtttggaccatgtctgttctgcttatctcactagatcactttgtctctctgtgcacttcagtcacctcttggttgaaataggtgacaagggcacagagaggggagggggcttgaccaaggccaaagagctgcacagtagccatcattgtattcccagcactttgggagacggtggtaggaggactgcttgagctcaggagtttaagaccagcctgggcaacatagcaagacgtcgtctctgttaaaaattaacaacaacaacaaaaagtagccaggcatggtggtgcacaccagtaatccaagctacttgggaagctgaagtgggaggatcacttgagcccaggagattgaagctgcagtgagctatgatcgcaccactaccccccagcc

SEQ ID NO: 363321 - DNA, 2214 bp, Homo sapiens
  misc_feature (909)..(909): n is a, c, g, or t
gttttggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgacggccccggcccaggtggttctggagcaggggatgaggaggcaccttatcagcagagcacttctccacagcgggtgtcacaggttaggattcctaaggcccttccttctccccagaagaccaacccctgtgagatatgtggcccagtcttgagacagattttgcacttggttgaacaccaaggaacacaccatggtcagaaactgtatacagacggggcatgtaggaaacaattacaatttactgcataccttcatcagcaccagaagcagcatgttggacagaaacacttcagaagcaatgggggcagagacatgtttttgagcagctgcacatttgaagtatctgggaagcccttcacttgcaaggaggttgggaaggatttcctggtgagatcaagatttcttcagcaacaggctgctcacaccagaaagaagtcaaacagaaccaagagtgcagtggcctttcacagtgtaaaaaatcattacaactggggagaatgtgtgaaagctttcagctacaaacatgtacgtgttcagcaccagggagacctcattagggaaagatcttacatgtgcagtgaatgtgggaaatcttttagcacaagctgtagcctcagtgatcatttgagagttcacacttcagaaaagccttatacatgtggagaatgtgggaaatcctataggcanagctctagccttattacgcaccgaagaattcacactggagtaagacctcatcaatgtgatgaatgtggaaaattatttaacaggaagtatgaccttcttatacatcagagagttcatactggagaaaggccttacaagtgcagtgaatgtgggaaatcctttagccatagctctagcctcattacacaccagagaattcatactggaatgaggccttatgagtgcagtgaatgtgggaaatcttttatccatagttctagccttattacacaccagagagttcacactggtacaaggccttatatgtgcagtgaatgtgggaaatcctttagccagagctgtcacctcattaaacaccggagacttcacattggagaagggccttatgagtgtagtgaatgtgggaaattgtttacttatagatctcgtttcttccaacaccagagagttcatactggagtaagatctcatgaatgtcatgaatgtggaaaattatttagcaggaaatttgacctcattgtacatgagagagttcacacaggagaaaggccatatgagtgcagtgaatgtggaaaatcctttacctgtaaatcctacctcatctcacactggaaagttcatactggagcaaggccttatgaatgtggggagtgtgggaaatcatttactcatagctctacgctccttcaacaccagagagttcacactggagaaaggccttatgagtgcaatgaatgtgggaagttttttagccagagctccagcctcattagacataggagaagtcacaccggagaaaggccttatgagtgcagtgagtgttggaaatcctttagtaaccactctagcctcgttaaacaccgaagagttcataccggagaaaggccttatgaatgcagtgaatgtggaaaatcctttagccagagctctaacctcactaatcaccagcgaattcacagtggggaaaggccttatgagtgtagtgactgtggaaaattttttaccttcaactccaacctcctaaaacatcagaacgttcacaagggataaaggttaggtaacacacatagggctgttacggactgagaagtgtccctgcaaaattcacagacataaataaataaatacgtattttcaataaccatgttttatatttagtatatgttctctgaattttgttttatacaaataagtttatatgtgtacatactactttgtctcatatccacacagaaaaccaaatggtttctttttttaaaaaaattctttgtgtttaaatggacaaattataattgtacatgttct

SEQ ID NO: 363322 - DNA, 890 bp, Homo sapiens
gttttggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgacggccccggcccagggcattgtgacctttgaggacgtggctgtttacttctcctggaaggaatggggtcttcttgatgaggctcagaaatgcctgtaccacgatgtgatgctggagaacttgacacttacaacctccctgggtggttctggagcaggggatgaggaggcaccttatcagcagagcacttctccacagcgggtgtcacaggttaggattcctaaggcccttccttctccccagaagaccaacccctgtgagatatgtggcccagtcttgagacagattttgcacttggttgaacaccaaggaacacaccatggtcagaaactgtatacagacggggcatgtaggaaacaattacaatttactgcataccttcatcagcaccagaagcagcatgttggacagaaacacttcagcctctgattggttgtgcaccagtccttcataggattggaggcctttaaagaactcttggggtattataaaattctagcttattcatggcaaaaaccgcaattacttttgcaccaacctaataaaaccctaaaaaacattgtaatcggggttcttgagccgcttggtcgcctgctcccacacctacattccacttctgtggagtgtactttcccctcaataaatctgcgctttcattggtccgttcttt

SEQ ID NO: 363323 - DNA, 2341 bp, Homo sapiens
  misc_feature (1036)..(1036): n is a, c, g, or t
gttttggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgacggccccggcccagggcattgtgacctttgaggacgtggctgtttacttctcctggaaggaatggggtcttcttgatgaggctcagaaatgcctgtaccacgatgtgatgctggagaacttgacacttacaacctccctgggtggttctggagcaggggatgaggaggcaccttatcagcagagcacttctccacagcgggtgtcacaggttaggattcctaaggcccttccttctccccagaagaccaacccctgtgagatatgtggcccagtcttgagacagattttgcacttggttgaacaccaaggaacacaccatggtcagaaactgtatacagacggggcatgtaggaaacaattacaatttactgcataccttcatcagcaccagaagcagcatgttggacagaaacacttcagaagcaatgggggcagagacatgtttttgagcagctgcacatttgaagtatctgggaagcccttcacttgcaaggaggttgggaaggatttcctggtgagatcaagatttcttcagcaacaggctgctcacaccagaaagaagtcaaacagaaccaagagtgcagtggcctttcacagtgtaaaaaatcattacaactggggagaatgtgtgaaagctttcagctacaaacatgtacgtgttcagcaccagggagacctcattagggaaagatcttacatgtgcagtgaatgtgggaaatcttttagcacaagctgtagcctcagtgatcatttgagagttcacacttcagaaaagccttatacatgtggagaatgtgggaaatcctataggcanagctctagccttattacgcaccgaagaattcacactggagtaagacctcatcaatgtgatgaatgtggaaaattatttaacaggaagtatgaccttcttatacatcagagagttcatactggagaaaggccttacaagtgcagtgaatgtgggaaatcctttagccatagctctagcctcattacacaccagagaattcatactggaatgaggccttatgagtgcagtgaatgtgggaaatcttttatccatagttctagccttattacacaccagagagttcacactggtacaaggccttatatgtgcagtgaatgtgggaaatcctttagccagagctgtcacctcattaaacaccggagacttcacattggagaagggccttatgagtgtagtgaatgtgggaaattgtttacttatagatctcgtttcttccaacaccagagagttcatactggagtaagatctcatgaatgtcatgaatgtggaaaattatttagcaggaaatttgacctcattgtacatgagagagttcacacaggagaaaggccatatgagtgcagtgaatgtggaaaatcctttacctgtaaatcctacctcatctcacactggaaagttcatactggagcaaggccttatgaatgtggggagtgtgggaaatcatttactcatagctctacgctccttcaacaccagagagttcacactggagaaaggccttatgagtgcaatgaatgtgggaagttttttagccagagctccagcctcattagacataggagaagtcacaccggagaaaggccttatgagtgcagtgagtgttggaaatcctttagtaaccactctagcctcgttaaacaccgaagagttcataccggagaaaggccttatgaatgcagtgaatgtggaaaatcctttagccagagctctaacctcactaatcaccagcgaattcacagtggggaaaggccttatgagtgtagtgactgtggaaaattttttaccttcaactccaacctcctaaaacatcagaacgttcacaagggataaaggttaggtaacacacatagggctgttacggactgagaagtgtccctgcaaaattcacagacataaataaataaatacgtattttcaataaccatgttttatatttagtatatgttctctgaattttgttttatacaaataagtttatatgtgtacatactactttgtctcatatccacacagaaaaccaaatggtttctttttttaaaaaaattctttgtgtttaaatggacaaattataattgtacatgttct

SEQ ID NO: 363324 - DNA, 2600 bp, Homo sapiens
gaactctgtttttgttggcaagattgttcttattgtagaagtggatattatcagattattttagatgttattcaacatttgatttatttaccaaattgtccttactttgaatataagcaaacttttttattgtggtaaagtatacatagcataaaattaccattctaatcattttttaatgtaccatttagtggcattaattacaagcaaccttttttttttttttttgagacatagcctcactctgtcacccaggctggagttcagtggcactatctcagctcactgcaatctctgcttcctgggttcaagcgattcttgtgcctcagccctcccgagtaactgggattacaggcacacaccaccatgcccagctaatttttttgtatttttaatagagatggggtttcattatattggttaggttggtcttgaactcctgacctcaagtgatctgcctgccttggcctcccaaagtgctgggattataggcatgagccaccgcgtctggcatacaaacttttgattacagtttgacacctgttgatggacagaaaatggagtaaccgtccaggcaggaatgttctagtctgtgtgacagttacagttcattttataaataaacaattgactttttttggtagttatggtccctaccctcagtgctgtatctctatttggtattcaaacaaatccagggaatctgcaaggctgaagggcagattcttggcaatggtaaattcagtaggtcctgccaccatttgaggcctcctcggagacagccatactagtctaatctcttcttgactttcccttcttctttcccagtcctctaattcccagaggtctgttgtgaattctaatgctttcagaaaatattacggagaatcccacaatgataaaatttcccagtttttgttttaaaacaaagttgaaaaatattatattaggggtcagggtgaggtgctgttgatggtgacagatggcccccttggcgacagggaagtatgaaatagcatggagtgtggaagggtactatgggtagcttatttattagatcagtataaagtatagatttaagagagttagattaaaatggcatgcttgattcaagtcattaaattctaaagttctattaaaattgtagaggagatacaataatacaaatttcagcaataaggatagatttataatcacactaggaagacaagaagggtgctgtgaaatatttctagaagatacaaaacaaggaattagatcttggtgaaaccaagagagccaaggaactgacagccacatgccgatgataattaaagaattacctccagttgtagagacagctctgagatggggtgtctgtagtgtgctaagccagatttttgaaggactagatagttattctggtctctgactcagagctgctggtccacagaattcctctaagctaaagctgtaacacaatttgatgtttgccaaataaggtgagactcacagagtatatgtgcagagcatataatgcagagcatacaaataggggccatcgaagtgtggcaatgccctaggtatattgtgattaccacaaggagctttattcctcatacttagaaaacaagcacacaaagaaaaatctgccagctgtctatttcccaattttccttctgactgttcctttctccttcctcacacaattaaaatgctaggtttcctgtaatcgcaatcttcagggaatttttcactcaagcccagaaaataaactccagataatgatactgagaaatttattggttggaaaactgctatctacaggccttccactacctatttcttagtagattttacatttttaaagggttgtagaacaccaaaacaatatatgacagatactgtgtttgggccttaaagcctaccctttatataaaaagtttgttgactcctaggctctcatttgcaagtagacaaatgagaaacagcaaatatttaaggaaaagagcaacatgaaaaatacacagcaaacttaacaagcagaaagaattcctggggaaacaattcagggggaaaaaatgaccaagtataattagtattatatggaataataattactactacttataatagtttcatatgtaatcctcatcatattatatgtcataatcttcaaatattttagaggttattgtactaattttaaaaatgcaagttgctataaagaagtatcttggaaataaacagttgtgaaaataaactctgttttaggctgattagttgaataaacatggctgagaatcaaattactgagctagaattttgagctgaagatacttccagagcttacaagaaaagataaaaaagatggaagttacagtaaaagacatagatgtatctcttaaagacatagaaaacccagaacaccatctgtttaaaaattaaacttcatgagattaagagccatatgtatagagaattcaccattgaataccctgcatatatcacagtgccaggtaaatactatgcaataaatatttttgaatgtatgtatgtatgttacagtataaatatatagaggagttccagaaagtgaaaaaagaagtgaagaataggaa

SEQ ID NO: 363325 - DNA, 3315 bp, Homo sapiens
gggcaggaggcgtgaggagaaactacgcgttagaactacgactcccagcaggccctgggccgcgccctccgcgcgtgcgcattcctagggccgggcgcgggggcggggagtccgggaggatttaacccaggagaccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccaggaatttttctttaaatgtggagcacaccccacctctgacaaggaaacaccagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatcgaaataccaactatgtgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtgg

SEQ ID NO: 363326 - DNA, 464 bp, Homo sapiens
gggcaggaggcgtgaggagaaactacgcgttagaactacgactcccagcaggccctgggccgcgccctccgcgcgtgcgcattcctagggccgggcgcgggggcggggagtccgggaggatttaacccaggagaccgctggtgggaggcgcggctggcgccgctgcgcgcatgggcctgttcctggcccgcagccgccacctacccagtgaccatgatagttaatctgcttaaatacttcaagctgtacaagtctgctgtggaagtgagcaccacacaatgtggcttcagcttccgatgtgatttctatttgaactccgatattagaaaccatgtcttagacctcccatgcagctctcaaagtgctttgcattgttgtggttacatggaaatgttaaacaaatgagttaatggaataatttttatttaattgtttttaataaatattcatgaaaaatgtaacta

SEQ ID NO: 363327 - DNA, 386 bp, Homo sapiens
ttttttatggctgcataatattccatagtatgtgccacattttctttatccaggctaccattgatgggcatctaggttgattccatgtctttgctattgtgaagggtgctacgatgaacctatgagtgcctgtgtctttatgttaatctgcttaaatacttcaagctgtacaagtctgctgtggaagtgagcaccacacaatgtggcttcagcttccgatgtgatttctatttgaactccgatattagaaaccatgtcttagacctcccatgcagctctcaaagtgctttgcattgttgtggttacatggaaatgttaaacaaatgagttaatggaataatttttatttaattgtttttaataaatattcatgaaaaatgtaacta

SEQ ID NO: 363328 - DNA, 3399 bp, Homo sapiens
gggcaggaggcgtgaggagaaactacgcgttagaactacgactcccagcaggccctgggccgcgccctccgcgcgtgcgcattcctagggccgggcgcgggggcggggagtccgggaggatttaacccaggagaccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcagaattgtgacctggatcagcagagcattgttcacattgtgcagagaccgtggagaaaaggtcaagaaatgaatgcaactggaggcgacgaccccagaaacgcggcgggaggctgtgagcgggagccccagagcttgactcgggtggacctcagcagctcagtcctcccaggagactctgtggggctggctgtcattctgcacactgacagcaggaaggactcaccaccagctggaagtccagcaggtagatcaatctacaacagcttttatgtgtattgcaaaggcccctgtcaaagagtgcagccgggaaaactcagggtacagtgcagcacctgcaggcaggcaacgctcaccttgacccagggtccatcttgctgggatgatgttttaattccaaaccggatgagtggtgaatgccaatccccacactgccctgggactagtgcagaatttttctttaaatgtggagcacaccccacctctgacaaggaaacaccagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatcgaaataccaactatgtgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtgg

SEQ ID NO: 363329 - DNA, 2952 bp, Homo sapiens
gggcaggaggcgtgaggagaaactacgcgttagaactacgactcccagcaggccctgggccgcgccctccgcgcgtgcgcattcctagggccgggcgcgggggcggggagtccgggaggatttaacccaggagaccgctggtgggaggcgcggctggcgccgctgcgcgcatgggcctgttcctggcccgcagccgccacctacccagtgaccatgatagtgtttgtcaggttcaactccagccatggtttcccagtggaggtcgattctgacaccagcatcttccagctcaaggaggtggttgctaagcgacagggggttccggctgaccagttgcgtgtgattttcgcagggaaggagctgaggaatgactggactgtgcaggaatttttctttaaatgtggagcacaccccacctctgacaaggaaacaccagtagctttgcacctgatcgcaacaaatagtcggaacatcacttgcattacgtgcacagacgtcaggagccccgtcctggttttccagtgcaactcccgccacgtgatttgcttagactgtttccacttatactgtgtgacaagactcaatgatcggcagtttgttcacgaccctcaacttggctactccctgccttgtgtggctggctgtcccaactccttgattaaagagctccatcacttcaggattctgggagaagagcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtgggtttgccttctgccgggaatgtaaagaagcgtaccatgaaggggagtgcagtgccgtatttgaagcctcaggaacaactactcaggcctacagagtcgatgaaagagccgccgagcaggctcgttgggaagcagcctccaaagaaaccatcaagaaaaccaccaagccctgtccccgctgccatgtaccagtggaaaaaaatggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatcgaaataccaactatgtgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtgg

SEQ ID NO: 363330 - DNA, 1537 bp, Homo sapiens
gaagctttaaaaatcttaacatatccaagtaattgccgctcttagcaaagaagtcaccatgggatgcgatgccattattccagcgggagttcctgcccaactcttacctgagtcggtgcttctcatctactcctcatcccccttaatgacagtagactccatctccgttctcaaaagatttctcaccatggagatactgttttaccatacaaagaagggaccaggcgacatggctcatacctgtaatgccaacgctttgggaagctgggcccaggagttcaagaccagtgtgggcaacatggtgaacaaaaaatttgtttaaaaattagctgggtgtggtggttcacacctctagtcccacctactctggaggccgaggtgggaagattgctgaagcccaggaggtcaaggctacagtgagcttgatcgtgcctctgcactccagcctgggcagcagagggagactctgtctcaggggaaaacaaaaaagaaaaatctgaatgtaagagacaagttataacactaaatgacagcagaattattgagaaatttgttcctacttaaggtgatatatttgagaagtaaaaggttcgtttgaatgatacacatcctggcataataaagcccctttcctgtggtcgccctttatagtgagacagaaaagcctgttagagcctcccaaaaggagcatgtttgggaatgggaagggatagaaaaactacaactgctcttgttcattcagagccatccctagacctgggccttgaccccacgcacccctccttccctgtctgcactccctgcacagtgtgatccacaggaatcccaaagctcttcaggcccttctaatacttcccttctgtttctctaggtatttctgggaaaagccagcttctgtttgcactggtcttcacaactcgttacctggatctttttacttcatttatttcattgtataacacatctatgaaggtatggtatgccatccacaggaatgtatttcatctacagtgcacaggtctatggacacttaatttatgtcagctgtgtatttttaattaaaatgctccaaaaataatgtcttaatatgctgttcttgactttaaaactttcagaccaccttgtatatataactgggactaaacgagctatcagtaagcatacatttttggtttcaaaacagtagttaattaaaatactttgaagttagaacttttttattttaggttccttaagtatgataaatctaaagctcttgataactctgtaagtaagagcggtaactattatattttcaagccgtgggaaattacagagtccccagagaaatccagcaagttggtacataacaaggaacgaaagcaggactcctagttgcagtgtctcatttcgctgctgtgtgaggaactgtctataggcttctatcttttttctttgccactgagtcagttttacttaaactgttgtgtgtgtgtcatttttattacatttgccgtgcttaaatgatctctataccatcatttacttagtaacgtat

SEQ ID NO: 363331 - DNA, 316 bp, Homo sapiens
gcggccgcctactactactactgctcgaattcaagcttctaacgatgtacggggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363332 - DNA, 254 bp, Homo sapiens
actgcagaaggaatggctacacagagcttccagacctttccatgcgttgtgctctccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363333 - DNA, 2838 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363334 - DNA, 3051 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaaaaaaaaaaaaaaaaaaaaaaaaaaaacacttgtgtggggccgccgcgggcccccaaaaaatttcttctaaacccatcccgttggggggcgcggggccccagagtaacggcagacctggggcccaacgcggtcccaagaagaacccgggcaggacaagggctgggtttcccccaaataaaaaaacccccgggggacccgcggtctggaccacca

SEQ ID NO: 363335 - DNA, 2784 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggctctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363336 - DNA, 3160 bp, Homo sapiens
  misc_feature (3160)..(3160): n is a, c, g, or t
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttcacacccaccccagcaccaccccaacaaccaacacacaaacgccccaaacaccaacagggggcgacgcacagaaaaaatcgcacagggggcccacatatcgcgctccactttctgtccaaaggggcccaaatagggggccacaccaaaccacgagcacggcggcattatcacacacgtggccgggcacacgcctcggccccccggcagggaaccacaccggtggggcagatcggcaacacccagcaaaatacacgcggccacacaactacgccacggtaacccactactttgctaacgctcgcgtatgatcaccn

SEQ ID NO: 363337 - DNA, 2904 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttattgaggtgtttgtgtgtttttcaatgtaagcatcatgagaaataaagcaaagttcaga

SEQ ID NO: 363338 - DNA, 2725 bp, Homo sapiens
ggagcggcggcccctgagaggaagcggcgaagatggccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363339 - DNA, 2736 bp, Homo sapiens
aagcactggtatcaacgcagagtgcccattacggccgggggccgccgaacagccgccaccgccgcgcgccatgaacattttccggctgactggggacctgtcccacctggcggccatcgtcatcctgctgctgaagatctggaagacgcgctcctgcgcccttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363340 - DNA, 3467 bp, Homo sapiens
gaagctttaaaaatcttaacatatccaagtaattgccgctcttagcaaagaagtcaccatgggatgcgatgccattattccagcgggagttcctgcccaactcttacctgagtcggtgcttctcatctactcctcatcccccttaatgacagtagactccatctccgttctcaaaagatttctcaccatggagatactgttttaccatacaaagaagggaccaggcgacatggctcatacctgtaatgccaacgctttgggaagctgggcccaggagttcaagaccagtgtgggcaacatggtgaacaaaaaatttgtttaaaaattagctgggtgtggtggttcacacctctagtcccacctactctggaggccgaggtgggaagattgctgaagcccaggaggtcaaggctacagtgagcttgatcgtgcctctgcactccagcctgggcagcagagggagactctgtctcaggggaaaacaaaaaagaaaaatctgaatgtaagagacaagttataacactaaatgacagcagaattattgagaaatttgttcctacttaaggtgatatatttgagaagtaaaaggttcgtttgaatgatacacatcctggcataataaagcccctttcctgtggtcgccctttatagtgagacagaaaagcctgttagagcctcccaaaaggagcatgtttgggaatgggaagggatagaaaaactacaactgctcttgttcattcagagccatccctagacctgggccttgaccccacgcacccctccttccctgtctgcactccctgcacagtgtgatccacaggaatcccaaagctcttcaggcccttctaatacttcccttctgtttctctaggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363341 - DNA, 2937 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccgggtcttgctctgtcacccaggctagagtgcagggatgtgaccacagctcactcagcctcagcctcctggagtcacgcaatcctcccacctcaacctcccatgtagctgggaccacaggtcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363342 - DNA, 2635 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363343 - DNA, 2838 bp, Homo sapiens
ttatgtggctttctagaaaaggcaaaactatggacagagaacataagtgtgattgcactgcaggaggtgaaggaagcctgggggagtttgactgcgaagcggcagcatggcagaattttggggatgatggaactattctgtgtcctaattttggtggtggttatgcctcagaactgaacacctccaaaaaagagaattttactatatttaagttttaaaattccaaaaacaaagctaaggaaaaaaatcttgcctttccaaatacatgggtgattaaaaaagctggggggtgctggaacagtggcaaggtattgacacctggtgttttttcttttatttgtaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363344 - DNA, 2734 bp, Homo sapiens
ggggttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccaggcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363345 - DNA, 2537 bp, Homo sapiens
  misc_feature (2456)..(2456): n is a, c, g, or t
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggaaaaaaaaaaaaaaaaaaaaaaaaaaaaaagggggggggataaaatatctccgggggggcccagattggaccaacccgattttcttgaaagggggcctatagggaggcatatataaagaaggcggggagcggttacaagagtggtacagggaaacgtgctagtgggttttgggaagacctcttcgtgtgtgcattgggaaccactccgattggaccggataaaattgagtatggtaacgtattcggtggagtgtctagtatataatacnggtgaatatagagacgacatgggtgtgatactggccggagcaaagtgtcatataggagtcgtaaggactgtacatagtgta

SEQ ID NO: 363346 - DNA, 2223 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcataatgtcttacagatgattatgtgaactttaaatgtctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaagga

SEQ ID NO: 363347 - DNA, 2585 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363348 - DNA, 1981 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctccgattgcaaagagttcttccattatcactttggcggtgggtaagaatgagtacacaggaattttgattgaaactggggcaggacgagataatgcatgcctttacattactgaacatggactgtggagaggttgctgtaagaattttacgcacgcagtgcgaagatcggtagttccttggtaggagtgagggattacaggaactttgtggcatgaggttatgttagccatcctaaaaaaggacgtatgttgaaaccatggcataccattgggcttgtcaagggaatagggcctttgggacca

SEQ ID NO: 363349 - DNA, 1909 bp, Homo sapiens
tcgcgaacgatgtatctctcgcgaacgtgttatctctcgcgaacgtgttatcctctcgcgaacgtgttatcccaattgaagctacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363350 - DNA, 1805 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggccccctttcccccagccttttttaaatccaaaaaattttttaattggccccaaatctgggcccctttggccaaattcccctaatgggggggtatttaaaaaaaaggggccccgttttaaaaaacggtgggtgggaaaaaccccggggttcccccaaataaagcctttggaaaaaaacccctttttcccagggggggaaaaacaaaaaaggccccccccatgggccttttcaaaaaagtggccccccctaaagggcaaaggaaaatttggggcgaataattttctaaaaaactgccaaaaaattttgttaaaacccctcttttttaaaacaaatgggcaaaattgggaaaaaccctctttaaaataaaaaaaaaacccccctaaagggttagaggtttttccccctttgaacaaaagggcccttctaatagtggtctccccccggggcg

SEQ ID NO: 363351 - DNA, 1295 bp, Homo sapiens
gttcagcacatttaggtcacactttaaattaagccttatattaggcccctctattttcaggatataattcttaactatcattatttacctgattttaatcatcagattcgaaattctgtgccatggcgtatatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363352 - DNA, 813 bp, Homo sapiens
  misc_feature (2)..(2): n is a, c, g, or t
  misc_feature (5)..(5): n is a, c, g, or t
  misc_feature (12)..(12): n is a, c, g, or t
  misc_feature (14)..(14): n is a, c, g, or t
  misc_feature (53)..(53): n is a, c, g, or t
gnttngctgccngntgtcgctctagaggatccccgccattcctgcctttgccntttggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363353 - DNA, 1465 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaaaaaaaaaaaaaaaaaaaaaaaaaaaaaaaaaaaaaaaaacaaaaaaaaaaaaagaaaaaaagcaaaaaagaaaaaaaaagaaaaaaaaaaaaagaaaaacaagggggggcgggcgcagcacaaaataatacctcctagcggggcgggccacaacgaagcgcgccagacgcgctgtctctttgtaaagagaaggggggcggcccccacatggaaggtgcggtagattaatataaaaggcgaggggcggcgcgccggcggcgtttataaacacaaccccggagtgggggacgagcaacacacgcgctggctgggtgcagctcgttgtggtggagagacaacaccaccactcctgggggtgggggcgacatcactagatggggcacgcccaccctcagcgacggggt

SEQ ID NO: 363354 - DNA, 808 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaa

SEQ ID NO: 363355 - DNA, 825 bp, Homo sapiens
cgcgcgcgcgcgcgcggcagttcggccacgtccctggccacgtcgcgggcgatctcgccatcttcgccggccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctacaggtagatcttgtagtcagtgcctggttataaacctgtgatggtgtagcttctgacatctggacgtaagaag

SEQ ID NO: 363356 - DNA, 2866 bp, Homo sapiens
  misc_feature (2866)..(2866): n is a, c, g, or t
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttaaaaaaacacaaaaaaaaggn

SEQ ID NO: 363357 - DNA, 3038 bp, Homo sapiens
ggggttcgccgttactctgcgcacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363358 - DNA, 2791 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363359 - DNA, 2609 bp, Homo sapiens
  misc_feature (2585)..(2586): n is a, c, g, or t
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggatgcacaannccggaagggtaccggagctcgaa

SEQ ID NO: 363360 - DNA, 2772 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363361 - DNA, 2188 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaagga

SEQ ID NO: 363362 - DNA, 2644 bp, Homo sapiens
cccgccgtaccagttgcggtgtttcattcataaagcagcagatgaggccatgcttctccctgtcgacacctccttgtcctctcaacataactgtcctgcaggcacagacatatttccagacaatgcaggcgatgctcctgctacaacgacatggtgaataccaacccatctctcaagaatacctaaaaattaaggttttctttttccaacgtgcccacaccaccccctatgtcccgcctgaagtagttattaagaaagttgtcccttttcccttttctataaccaaatagacaggaatgtaagattctccccggggcctgaaagcttaaggggatgaataactcctccccttctcaggcccagttccaaggtgcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaa

SEQ ID NO: 363363 - DNA, 1856 bp, Homo sapiens
  misc_feature (1776)..(1776): n is a, c, g, or t
  misc_feature (1778)..(1778): n is a, c, g, or t
  misc_feature (1780)..(1780): n is a, c, g, or t
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagtttttttttaatgtggaggaccactaacattccttacatcttttgnangngggggccttaataaaccgcaccgacaacggagtcggtcgcgtgtgtcacagcgggcggttttcaccaaggctttag

SEQ ID NO: 363364 - DNA, 1519 bp, Homo sapiens
  misc_feature (1400)..(1400): n is a, c, g, or t
  misc_feature (1418)..(1418): n is a, c, g, or t
  misc_feature (1425)..(1425): n is a, c, g, or t
  misc_feature (1442)..(1442): n is a, c, g, or t
  misc_feature (1454)..(1454): n is a, c, g, or t
  misc_feature (1500)..(1500): n is a, c, g, or t
  misc_feature (1518)..(1518): n is a, c, g, or t
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggttacccaaccattttgaagattctggaatgtncgatgggagtctccactngaagagncaccccaaagggcgctngcccctgcctgncccctggcttggggaaagtgtcccagtttgggagactgtgcccccnaagggtgcctggaaagant

SEQ ID NO: 363365 - DNA, 1061 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaa

SEQ ID NO: 363366 - DNA, 940 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgccgatctgggagatggccaattgggttcaccgtctggggggggctgcttattagtctcctggactaggggggcaagagatcacagtgtcatccaacgtgtcagaaggtgctc

SEQ ID NO: 363367 - DNA, 904 bp, Homo sapiens
cgcgcgcgcgcgcgcggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctacaggtagatcttgtagtcagtgcctggttataaacctgtgatggtgtagcttctgacatctggacgtaagaag

SEQ ID NO: 363368 - DNA, 1009 bp, Homo sapiens
cccaagtgtggttgcagatttttcttggctatcttaaagagtaaagtaagcaaattacaaatcaaagaaactctgaaccagtggtcttcatccaagagagcctctggtggtcagaaggaaagtctcaagcattcagactgtggcaggaaccctgtcatggaatctggcagctaaacccgaaagcaagaggcttgaccactgcagaacactcgggtaggtaggaaacaatgaaagagcttccaaaatcaaaatcagaaacccaattccaggacttggtgactgcagtacttcctgcctgtcaccatctagggcagctcagatgtgcagtccagcatgaacacaccttgaggatgaggcagcgcatccctgctgctgccgccgctgatggcaccatcagggcagactaggtttgctgaccaggctaggtgtggaccagcacacctacctttccctaaatgggcccgtggcatgtgtcctttcaaaatgttcccttggcagtgtgctccttgcatggctttgctcctaggacacatccaaaagggtcccctgcacactgcgaagggcttctggggcgtgacctgtctttagtggttctgagtctcaggacttggggctgatgcagggcctctagctgaagggactttgatggaaatgtgcagacacaaatgttgcccaaggaccacgagtacagcaggtgctgcagttacggggcacgcccattcctaatcattgtgctttgtgtctcctcagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363369 - DNA, 625 bp, Homo sapiens
gagagagagagagagagagagagagagagagagagagagagagagagatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363370 - DNA, 2369 bp, Homo sapiens
aagacagtctcgatctctgtcctgtggtatacagcatccagggaagtgcccagggaccagggcaggcagaggtcttcctgcctttaccccacctgggcccagttcctgcgcaggggcttggccagtcctggtcagctttccctctgatgactgcaggaagagagtcagacgcggaactcccagggtgcagaggcctgcggggtctgaagggcctcctccctctccagtgtggtgactgggctgaggagatgctgggactgagagtgtcatggtggagcctccgtccctgctcatcctctccgcatgttgcttctgctcccgatggctctctctgaaatgcagcacaacctcctaggccaatggaagaaggcccagagctggctccctgcctggaagcacgaggagacccgcacaggcatcctgagaaggcgtggagagcaggctgccttcatggggggagtgccagggcctgggcacccacacccgctgacccaagagggcccgggcacctgcgtgctggcctcttcactgaccttcgctctgtctgctctctttgtgtctctctctgacctccagaggcctcctttctctctgccaggaacagtagcccccctgcaaggccctccttttcctccagcccgcagcctgcggcctctccggttctgctccacagcccggctgccacacactcgcctctctctccaggccccccgggttccctccgcctctcttgctgcctgttctctccttttgcaggttgcgtttattggcttatctctgggggttggtgctctcccttgtttccatggaaactgcctggccccaggaggcccaagcagctttgagctccaagggcaggaccatgcaggccatcgctgccctgccgcttagccacagggcacgatttctgactcggtttattagagacatagtgtggcagtctctagaccccacagtcgggctggcatctggggacaggaccaacacccccacaccccagaggcgaactgtggtgagtgtaaagagcccctctccaggggaagacagccggccagagtgcggtgtgctgtgctggagagcacagccccaggcgtgacaaacacctcggcctcttagaagttgtcccttatctggacaggaagtctggaggctgaaacagagactcccaccttcccagagtctcctgggcagtgccacacagatgccatatgctggccccgtggccacactccagcactcagcccccttgcccacctcactcctgagttagcacactttccaggtgtcagcaggtgtgatcaggggctcagagccagggtcctgtgagagcccaggggtctttggttgcacctcctgcgtgcacttcctgacagcgcccacctcactgccacccagagctcagacccaagggagggtggagaggggctgagggacaggcctggagtaggggtgtatgcactgcaggctgagatgagcaattgaggggcaagtgtccagcaggagggagaaactgggaacagagtccttgtcactccaggggatgttgctgctcactcagcactcactcagggctctgggagccaggcctagctctcagggcagagggtgtggcagggaagtgagatgatcacactcagagcccagtgagaggcagtgaggaaaaccaccagcgagaccagtgtggtggctcacacctgtaatcccagcactttgggaagtcaaggcaggtggatcccttgagctcaggagttcaagaccagcctgggcaacatagcaagaccccatctctacaaaaaatacaaaaactagccaggcagggctgggcgcggtggctcacgcctgtaatcccagcactttgggaggccgaggcgggcggatctcgaggtcaggagattgagaccatcccggctaacacggtgaaaccccgtctctactaaaaatacaaaaaaaattagctgggcatggtggcaggtgcctgtagtcccagctactcgggaggctgaggcagaagaatggcgtgaacttgggaggtggagcttacagtgagccgagatcacaccactgcactccagcctgggggacagagcgagactccgtctcaaaaaaaaaaaaaaaaaaactagccaggcgggcatggtggtggcacccatctgtagtcccagctacttgggaggctgaggtgggaggatcgcctgagcctgagggggatgttgccgtgagccaagagcttgtgactggactccagcctgggcaacagagcaagaccctgtctcaaaaaaaaaaaaaaaagaaaaaccgctagcaatggagatgggaggaggcttcagagcccagagagcagcaagggttacacaggggggtaacaaggg

SEQ ID NO: 363371 - DNA, 1030 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcaaaaaaaaaaaactctcagcggatacggcaaaaggccaacactagagggccgaccacttgcccttagaggaaaacgcggaacaggaacg

SEQ ID NO: 363372 - DNA, 793 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaaggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363373 - DNA, 1079 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggtcagagctgggcccgctgtccctgccccagtggcgggggtggcgggcggggagggggcaggcgcggcacagcggcggcgtggccctgagtggccaggcctgtctgtcggtctaggcccagcacctgcagggcccatccgtgggctctgctcctgggcttcgctgccagccttaggaggcacgtccaggtcaggtggacgcagagtgcgtaccccagggtggtccaggctgggtagggctcctccgcttagctcccctccacctcttcactcaggccttcatcctacaacgtcgggaatcaagacagtttggggctgggcgccctggctcacgcctataatctttgggaccccagggcgggaggatcgtttgaggccatgagttttagaccactct

SEQ ID NO: 363374 - DNA, 970 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcaaaaaaaataggaaaaaaaaagaaacact

SEQ ID NO: 363375 - DNA, 963 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcaaaaaaaaaaaagtcgacgcgg

SEQ ID NO: 363376 - DNA, 936 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctcctctgcctcctctgtgctgtccgggatcctctagaacact

SEQ ID NO: 363377 - DNA, 1266 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagcagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcaaaaaaaaaaaaaaaaaaaaaaaaaaaaaattgtggtggggcggctgtgggcccctggggaaaaggtttttaagaccacttgggttgggggcgccgggggcccccgagtagaggatcaggtggaacacgtgtggtccaaaacgtgtgttccccaagaggaagaactcgtgggaccaagagaaggaagggcgtgctgtggggattctctcccccaagataaaaaaaaagagcgcgccggggggggccagacaccaggagcgtgggttcctggagacaaaagattccccaaagaggggggaggtgtcccgagggggcgccaaataacaaggggcagccacaaaccaaacaggggaggggcacaaagcgaggacgctccgagaattcaaatgtaaaagcgcccgggcctcgtggggg

SEQ ID NO: 363378 - DNA, 942 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363379 - DNA, 536 bp, Homo sapiens
ctcaaaaggcgcgtgcgcaaagcgaaggccggccgggcggggaagagaaatggcgaggcaggagtgcgggggagggagtggtccttagctgaatgcgcctgcgttgtggcggcctccggcgccccaaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363380 - DNA, 457 bp, Homo sapiens
gccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363381 - DNA, 626 bp, Homo sapiens
  misc_feature (11)..(11): n is a, c, g, or t
  misc_feature (504)..(504): n is a, c, g, or t
  misc_feature (541)..(541): n is a, c, g, or t
  misc_feature (557)..(557): n is a, c, g, or t
  misc_feature (562)..(562): n is a, c, g, or t
  misc_feature (564)..(564): n is a, c, g, or t
  misc_feature (567)..(567): n is a, c, g, or t
  misc_feature (580)..(580): n is a, c, g, or t
  misc_feature (588)..(588): n is a, c, g, or t
ggcgcaggcgntagggcctgggccggggtcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcaaaaaaaaaaaaaaaaaaaaaaaaaaaagggcttctttgcnggggggggaaaaaggggttggaagggccctgggccanagtgttcccggacccnttttntntgncccagggggaaancggcgggncccctaaggggagcgaataaattcgaaaacccgggtac

SEQ ID NO: 363382 - DNA, 1355 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcaaaaaaaaaaaaaaaaaaaaaaaaaaaaaattgtggtggggcggctgtgggcccctggggaaaaggtttttaagaccacttgggttgggggcgccgggggcccccgagtagaggatcaggtggaacacgtgtggtccaaaacgtgtgttccccaagaggaagaactcgtgggaccaagagaaggaagggcgtgctgtggggattctctcccccaagataaaaaaaaagagcgcgccggggggggccagacaccaggagcgtgggttcctggagacaaaagattccccaaagaggggggaggtgtcccgagggggcgccaaataacaaggggcagccacaaaccaaacaggggaggggcacaaagcgaggacgctccgagaattcaaatgtaaaagcgcccgggcctcgtggggg

SEQ ID NO: 363383 - DNA, 969 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtcatttatacccttatgaaaccaggtctat

SEQ ID NO: 363384 - DNA, 1122 bp, Homo sapiens
agcggcacgctttcttgaaagaggcatttaccgagcgcccaatgtatgcctggcactgggctgggtgctgccacctaagcgagcacgaccaatgcagtctatcagggaggcccagatcgccaagcagcggacccctgcggtccgccatgccactcccggctcctagagcgccgctcagcacaccgtgagcgcccaataactgttgggcttcaatgacgccgcggaggcggccccgtccccgcgctcccgcccctcccgccaggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgagaggcctcctttctctctgccaggaacagtagcccccctgcaaggccctccttttcctccagcccgcagcctgcggcctctccggttctgctccacagcccggctgccacacactcgcctctctctccaggccccccgggttccctccgcctctcttgctgcctgttctctccttttgcagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363385 - DNA, 447 bp, Homo sapiens
gagagagagagagagagagagagagagagagagagagagagagagagatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagatcctggtggacctgctgaagctgaacgtggcccccctcgccgtcttccagatgctcaacagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtca

SEQ ID NO: 363386 - DNA, 1430 bp, Homo sapiens
acttgtagtcccagctgctagagaggctgagatgggagggtggcttgagcccaggataccaaggctgtggtgagccatgattgtgccactgcattccagcagtgacaaagcaaggccccatctcaaaaataaataaataaaaagtaaaacaaccctccacacctggtctgaaattttctgtgattattcagccctcgaaacaactttcaggtacagtgactgccataatgtaaactggctcccaagaaggtcatactctccaatgtacattcagagtactgactctgagttttctgccaggtatgaatggtggtactgtcaactgaatatggaggtagatctgctattgctggttagttggcagtatacaccatgtatcaatgttaacatgtccaaagcttgaggattctatggaacatatagatagacatatctagtgtatatttagaaatttaggtatgaaaatctataatggtgggagctgaaagtaagagtgttgggactcttcagtatgtaaatccatatttgaaactatagaagtggaaaaactctttaggaatagtatttagattgaaacaggaaagaggaggataaagccgtcgaggaatactagcatttaagaaaaaaagaactagtgagcaagtaatgattatacaaggcaatatgagacaccaaatatgatgtcaaaaaagccaagaggggaaacatatccaaaaaataaatgagctgggcacaggggctcacgcctgtagtcccagctacttgggaggctaaggcaggaggatagcctaagccccaggagttgcaggctgcagtgagctgtaattgagccactgtactccagcctgggcaacagagtgagacccctatctctaaaaaaagaaacaaaaagtagatgatttcacagttaaacaatgagagctttttcaataaaatcaagagacaaggatatcagtgctatgatttttagtcactattgtgtttgctaacttctgttcttcttacaggtttcagtctacatgttacttccttgagaagcagtgtttgacacccttctcccccaatccagccatcccccaagtctgagttaggtatttctcttctgtattcccatagcacagtgtaattcccctataatagcatgtatcaccttgaattatgggtgtttattgttctgtctctcctgttagaacgaaagctccatgaagggattgtcattttattcaccagtgtaccctctatgcccagcacaacttttggtcatattaaacaaagaatgaataaataaatccaagagcataggaggaggagcatccaaatgagcctgaaaaattagagaaatatttgtagtagtatgtgatatcttagctgagcttaacaagtataatgagatcaagagtttggattgaaaatgaggtactcaggaataa

SEQ ID NO: 363387 - DNA, 3653 bp, Homo sapiens
acgccggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaacta

SEQ ID NO: 363388 - DNA, 3356 bp, Homo sapiens
gcgaccgccgacgctcccaccgctcctccacgactgcgggccgcgccagctccatgaatggaaatcggctccgcagacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaacta

SEQ ID NO: 363389 - DNA, 1382 bp, Homo sapiens
acgccggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatggtaagggaactaaagccatattctgtattgggtggtggatttctgtatgatgtgtgtacataaattttatatataattatacatactggtgtctcgaagtaatatttggacatgtattatgatctactggagaaacctttatatttttattacatttcatttagaaagcctgtagaatttaccttggaatgctgctaaacatgaagcaagcacatgaagacagatttaaaagccctgatgattatctgagcaatcttctattataactcacttttgcccttttaactctaagccaacattttattatgaaatatatattttaagaaagataattctgttgggcatggtgacccccagatgttatacccact

SEQ ID NO: 363390 - DNA, 123 bp, Homo sapiens
ggaatacagcttgtaactgtgactctttttttttccctttcccctggcaggacccgctggggcccagcccctactcatggtgcccagaagacctggctatggcaccatgggcaaacccattaa

SEQ ID NO: 363391 - DNA, 1730 bp, Homo sapiens
aggaaggagggtggccctaccccagcgggctcggctcggggcctccgcggcagttcggggtccttcacccgccggctccagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgaaagagacctctggcagcagtgtggagaatagatagaggagaaaaaactaatctgagaagccagttaggaggcttttcaatcactagttcaggtaagagatggtgatggtctaatgtgggatggagaggaaggattaagctgaaaaaataggtttaagaaccatgtccagaaaaaaaaaactttgggtgtagtactggtacatggaacggattggaaaaaaatagaccagagctttactagatttttgaaagaattgtttttgcaaataaactacaagcctggcatatcagtcaaggttcagaacctagagaagcagaaccagtacgaagtatagagagagagtttatgcaattgtaggggctagctaggcaagtctgaaattttgggggcaggctgtcaggaagggcagggaaattcaggcatgggctgaagcagttatctataagtggaatttcttgctctcagggaagcttcagccctacttttaagacctttcacctaattgaatcaggcccatccacattattcaggataatctccattacttaaagtcaacagattatggattttaattacatctacaaaataccttcatagcaacacctagattagtgtttgattaaacaaatggcagctggtagcctagcaagttaacacattaaaaacaacacctgccatgatggcttacacttgtaatcccagcactttgggaggccaaagtgggaggatcacttgagattaggagtttgcgatcaggctgaacaacatagtgagacctgatctctaccaaaa

SEQ ID NO: 363392 - DNA, 3507 bp, Homo sapiens
acgccggcgagcttccggggcggccccgggcaggtcggcggcggcggcccgcagtcgtggaggagcggtgggagcgtcggcggccgcgggcgatgcaacttccggacgggactcccctctgtccgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaacta

SEQ ID NO: 363393 - DNA, 3395 bp, Homo sapiens
acgccggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacaggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaatttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaacta

SEQ ID NO: 363394 - DNA, 1526 bp, Homo sapiens
acgccggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgaaagagacctctggcagcagtgtggagaatagatagaggagaaaaaactaatctgagaagccagttaggaggcttttcaatcactagttcaggtttcagtctacatgttacttccttgagaagcagtgtttgacacccttctcccccaatccagccatcccccaagtctgagttaggtatttctcttctgtattcccatagcacagtgtaattcccctataatagcatgtatcaccttgaattatgggtgtttattgttctgtctctcctgttagaacgaaagctccatgaagggattgtcattttattcaccagtgtaccctctatgcccagcacaacttttggtcatattaaacaaagaatgaataaataaatccaagagcataggaggaggagcatccaaatgagcctgaaaaattagagaaatatttgtagtagtatgtgatatcttagctgagcttaacaagtataatgagatcaagagtttggattgaaaatgaggtactcaggaataa

SEQ ID NO: 363395 - DNA, 476 bp, Homo sapiens
ccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccggtaaccaggccctgccccatctcctctgccatcttctctccttcccaaaggatctgggctccccttcttgtctgcttcttggggctccagcaccacccttctgagatcaccctccctgcttccccag

SEQ ID NO: 363396 - DNA, 736 bp, Homo sapiens
ccagcgcatcctcaagtaccacctgctgctccaggaaattgccaagcattttgatgaagaagaggatggctttgaggtggtggaggatgccattgacaccatgacctgtgtggcctggtacatcaacgacatgaagaggaggcatgagcacgcggtccggctccaggagattcagtcactcctcatcaactggaaggggcccgacctgaccacctacggggagcttgtcctggagggcacattccgcgtgcatcgcgtgcgcaatgaaaggacctttttcctctttgacaaaacactgcttatcaccaagaagcggggcgatcactttgtctacaagggcaacatcccgtgctcctccctgatgctgatcgaaagcaccagagactccctgtgcttcactgtcacccactacaagcacagcaagcagcagtacagcatccaggccaagacagtggaggagaaacggaactggactcaccacatcaagaggctcatcctagagaaccaccatgccaccattccccagaaggccaaggaagccatcttggaaatggattcctattatcccaatcggtaccgctgcagcccagagcggctgaagaaggcttggtcctcccaggatgaggtgtccaccaatgtgcgccaggggcgccggcaatctgagccaaccaaacacctgctcaggcaactcaacgagaaagcccgagcagcaggaatgaaggtaaaggccagtggg

SEQ ID NO: 363397 - DNA, 3311 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaatta

SEQ ID NO: 363398 - DNA, 780 bp, Homo sapiens
gttgtcctggggggtttgtttttttgctctcttattgtcccccgtgtgtgattaagtataaatttgatctgtttcgcgccggataatgtgtactcttagactcgctgtctggctggtttggtcgcgcacatttgtgtttcggtcgcctgcgccctgtgcccgcttcgtcccgatgttgttggtcgccgtggtgtggttgtgttgtttgtcagctccccgtggtgttggggggcgggtgtgctggtaggatctgtatctattatttatgtgcgccggtatgggggcgtggtgtgttaattattccggctctgtgtgtgtgttgggttgttcgctcgactatttttgttcccgccctcgtcgtgggggtatgggggtgttctttttttctcctatgtaggtgcccccgcgtgtgctgccgccgttcttctccccgctcttcttccttttttttataacccgcgccgccccgccgccgtggctgtatatatatagtagccgcctcctcttattgagggcgccccctttgttcccacaaaaccgtggggcgcgcgcgcgcgtggatcgtgggcgcccctccgtggggagaggcttcttctttcgcgcgcccgccccctctctcttttttttttttttttttttttttttttttttttttttttttttttttttttttttttttttttttttattttggcagggtgtgtggctcctggatgggctcgtggggcgggatgggacagggcacgggctctcagaaaataaactgctttattggaatta

SEQ ID NO: 363399 - DNA, 203 bp, Homo sapiens
tgtgtggaattttaagtgataagtgagggagaaatccagccatatctgtttccacactggctggatagacttgtggggctctttctggagacccataacctctcaccgggaggactctttcagtctggaccaggggcctacaggctacttggacaaaatttggcccgctgcatgtttttgtaaataaaatttttttggcactg

SEQ ID NO: 363400 - DNA, 4061 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaattacaggagtgttggtggccggtgggcagagcctagcagggggtgcagccgccaaggcccgggtgtcccagctgttgctcaggagccgtgggccctgcaggagtatggggaggatatgatgtgtggggagcaggggggcaggtgccccagccctccagctgcagcttcctgaggttctagaagtttctcaggctttacaatgtgtagttgggagaatacgatggaagggtgaacccgactcccttcaaaggaatgaatccaaaaatctagtggagctgccgggcacccagaggcaggtgggacagagcaaggtgcagacgggtcacaccctccgccggcccgggccgctgcgttctcgcccagctctgtcgcgtattccaacacagacatgttttttcccagcaaaaatgctggctttgccacagctgacaaaaaaattccagaagatgcctttctgcagcagcacgctggtcctggggcccaggcccctcaggggtcgtcatctgcctcttccaccacctcctcgtccagctccctggcgtcctccatgctgttgtggcggacctgctcggggacggtgcgtggcagtgggagacccagcccccggtgcacggcgtccacggcctgcgggctcacgtagtaggacatgttggccaaggaataccagacggcctacagattcctggaggagatgcggcggcggcttcccttggccaacatgtccacggcctgcgggctcacgtagtaggacat

SEQ ID NO: 363401 - DNA, 3781 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacagagggagcgtcccgcaagattcctctgtggttgagctttgccatgaggcaccaggcatctgctccgatgctgggcttgtggcatggccggcagtgccgcccgcacgtgcccgacgccatcacctgctgggccctgctcgcctcctcctgcctcagccggcgctgcactggccccacgttcagggcgtgaggctctcgagatggcagagaagtgtggggcctgggttgtgctgcagcaggggtgggggtctcggcgttgggaactcctggcccaggtggacttgtgccagacagccctgcagggggagtaggcacccggaaatgtctgctcctacgatctcggtgcaggcaaggcggtgggcacgggaggaggggctgtgtggggctccctcggtctcccacggtggcccaggaggttggggacctggccctgaggcacccgctgcaccttgggctccatcctgtgctctaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaatta

SEQ ID NO: 363402 - DNA, 3276 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaatta

SEQ ID NO: 363403 - DNA, 3657 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacagagggagcgtcccgcaagattcctctgtggttgagctttgccatgaggcaccaggcatctgctccgatgctgggcttgtggcatggccggcagtgccgcccgcacgtgcccgacgccatcacctgctgggccctgctcgcctcctcctgcctcagccggcgctgcactggccccacgttcagggcgtgaggctctcgagatggcagagaagtgtggggcctgggttgtgctgcagcaggggtgggggtctcggcgttgggaactcctggcccaggtggacttgtgccagacagccctgcagggggagtaggcacccggaaatgtctgctcctacgatctcggtgcaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaatta

SEQ ID NO: 363404 - DNA, 608 bp, Homo sapiens
ggctgaggctggaagctgtggcaggttctcagccctgagctcctggggccacacagggtcgggtgagcacagggcccccagaaggattgcctggacacgttcacagactctctctagacgggggcccgagggaggctggggttaagggggccaccccctgcagtttgtccggccggggctgcagggcagccaggtcgctctgggtcggtggccgtgggtgtcagcctctctgctgccggctgcctggccatggaggagccctgtctgccttcaggctgtggaggtgacggcctgtcctcttatctgctgagaacctgggatctctctggggcattggccttgggggaggcccagctccttcgagaggggccacggcccctcagctttgagcactcccagtgctacccttggcctgaggtggaatcttagaaagtcgcttttaaaaagacacctggctatccagggcccagccactgagtgagaccgggctgcgagggaggccacagtggggagtggctcccgtggctccgtctcggggaggggcgctgcagcctggcggatgccgctgagcctgctcccctgctgtagtacgaagaggatgaactgag

SEQ ID NO: 363405 - DNA, 478 bp, Homo sapiens
ttggcactgtcaaaggaggccttcgagggtggacccgcctccgcccgggctgaggtgcagggaaggaggctgtcgggggtggacccgcctccgcccgggctgcggtgcacgcgctctctgggttgtggcatttatgccccagagaagggaggatgaaggcccagctcaggcagtcggaggatggaaccagaggctcgtggctaggaattggcaggccgggagtcaggccgccgtctgtgggcatcggagttcacgctctcgctcctccctgtctccaggccggcttgcagctctggcccctgactctgtcttgcaggcctgaggtcctttcgagactgctggggaacctggtggtgaagaacaagaaggcccagtttgtgatgacccagaagcttctgttcttacagtcccggctcacggtgaggacgccacggagggtgcaggctgctggctgccccatcacagcaagaatggctgc

SEQ ID NO: 363406 - DNA, 432 bp, Homo sapiens
gtggctgacaggcagcctggcctggtacttcccaaataggaagtgtgccaggcagggccgcagcgtgggtggtctgccacactgaggggagtgggaggtctggggtgtggtccctgccgagctcagcccccgccttcttgccggcagctacgtgcgccaggggctgttgtcggccgtctcctccgtcctgctcagcctgcctgctgcgcgcctgctggaggacctgatggacgagctgctggaagcccggtcctggctggcgggtgagtgtcggcctgcggtgtgtgtgtgagatgtgtgtcggcccggggtgtgtgtgtatgtgtgtgtgtgtgtgtgagagatgtgtcggcccggggtgtgtgtgtgtgtgtgtgtgatgtgtgttggcccggggtgtgtgtgtgtgtgtgtgtgtgtgtgtgtgtgtgt

SEQ ID NO: 363407 - DNA, 3030 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaaggtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaatta

SEQ ID NO: 363408 - DNA, 3205 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaatta

SEQ ID NO: 363409 - DNA, 3838 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaattacaggagtgttggtggccggtgggcagagcctagcagggggaatgtggtgatgaggggatgcggtgcccgcggaccgcacacatgccatgtgtggacactcaacaggaagcttcggtcagcatttcagctggaaatgcagagccagggccctggaaagtccctcagcagctgtgcacaggcctgctcaccgtgcgtgtgcgggcagagcctcctggggaggcagaggccccgcgttctgcactcgagtcttgcgggtggacatgcatatgtcagagtggagggcaggcagcgatatctactggtttggcttgggtattttttttttttgagatggagtctcagctatgaagatataataagcttgttggatggcccctcccatcacctggcagtggacctgcgtttaaggaaggcctcagctggggtgggcgctggtggagtgcaagccttccacacagtctcaaacgagaggctgagggcaaacatccacacctgaaaagatgctgccttacatgctgacaaaccac

SEQ ID NO: 363410 - DNA, 2701 bp, Homo sapiens
gcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcggcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctctcagaaaataaactgctttattggaattaaaaaaaaaaaa

SEQ ID NO: 363411 - DNA, 326 bp, Homo sapiens
gtggccgactatctgacctcacagttctatgccctcaactacagcctccggcagcgcatggacatcctggatgtaagtgcctcctgggcctcagtccccctggtctggcccaagctgccctaaggtggggctgccaaaacctgggtctccttgttgctgggccccaagggctcgtgcaggcctgtccactgccttcgtgagtgtgtgacccggcaggactcagcagtgggggagtcagggctcccggggcagagagttttgtttgtttaaaataacagctttactgatataattcacacgccataaaattcaccgctttagggtaa

SEQ ID NO: 363412 - DNA, 663 bp, Homo sapiens
acctgttcaacctgtgagtaatccaattactgttctgtctttgaggccaagagcctcagtccaagccagccatgttcatgctgtgtctgccccaagtgaggaggctaaggctggtgcatagcccgctctagggtggggtaaagcgggcagcagtaactttgcctctcataggctggggttggtcctggtcaattctttattttgtgtgaatcgcaaacatagttcaggtatacgtaacggaagtgcccctccctatgcattctccagctgtagggtacagtcatctccggggcattatagtaaatctcattagttcagacctgattaatgttgaactcacgactgttgagatgtaggtagtgcagtatacagaaaagaacaagagctctggaatgaggcatgtcagggctggaatcctggctccatcatagactagctgcatggccttgggtaaaagatttatcctttctaagtctctgtttagtctgtgtaaaatgggctgccagtatctcatgaggggattctaaatattgagagggcatatgatagacattcagtaaatgcctcttgccttccctgtgccaactttgtttatcctccactccatctaatttataatattcaaacagtgtcatgattgacatttttagttttattaagaaa

SEQ ID NO: 363413 - DNA, 650 bp, Homo sapiens
gggaaagctggaaggcagtgtgagagtgtggatcagagcccgctctagggtggggtaaagcgggcagcagtaactttgcctctcataggctggggttggtcctggtcaattctttattttgtgtgaatcgcaaacatagttcaggtatacgtaacggaagtgcccctccctatgcattctccagctgtagggtacagtcatctccggggcattatagtaaatctcattagttcagacctgattaatgttgaactcacgactgttgagatgtaggtagtgcagtatacagaaaagaacaagagctctggaatgaggcatgtcagggctggaatcctggctccatcatagactagctgcatggccttgggtaaaagatttatcctttctaagtctctgtttagtctgtgtaaaatgggctgccagtatctcatgaggggattctaaatattgagagggcatatgatagacattcagtaaatgcctcttgccttccctgtgccaactttgtttatcctccactccatctaatttataatattcaaacagtgtcatgattgacatttttagttttattaagaaattgaatttttaggaaaaaagtaaatataggaagaggaaggattatgatgctactgcttctccagggattt

SEQ ID NO: 363414 - DNA, 677 bp, Homo sapiens
gtaaatctgacaatatgtatattccccaccttcgagtctttgaaactatagctgtgaagatgtactttgagaacgtgaaatgtatttgcttgttaaattggggttcagattttaaaggagaaacttcccttggtttaggagctgtgtcataatgactgaaataattcagtttgagaaagtaccgacaataaaaaattgttgagaatagtgagtgagccctgatacgagtagttatatattttcagtttcattctgagcctgcctaattctgtgcagtccttgcagcatctcctgctagtaggtaattatcactttttctctggggaggcagtgctgcttttggactataatgtggaaactattactagagagtctagaagttggggtgggatagggtgtgtttactgagcttaaagcaagtaatgtcaatttgtgaagcaagcctaagaatgtgtgtatgtgtgttgaactgagaagagtatatcttaaatagggcagccatcatcttcaggtgatagttgctgtaagaatgatatcctgtattactgtatcttcctattttttcaagaaaagctggaaatctggacttgcgggtaaaaatctctggattattaaatgttggcaacgtattcagataaaacactttatggttcaaataaatcatgcccaacccactg

SEQ ID NO: 363415 - DNA, 458 bp, Homo sapiens
atgtcccctggatcgaccagcactgtcattccactgtgccctatttcttggttatgatgaaaagactcttaattccagtatgaaatcatttctgcattccataaatttcatttggcatctgtggaattaaggcatcttcattgtatttggatctctgaatcataagtgatatttgcctataaattaagcaatgatatttaaataagagattaccacaatcatattttataaatatacaaccatttttaaaaacctgacaaaatctacaaaaaaaagaaaatgaaatatatgtggagttttagaaaagactgactaggtccaaggttgaggcacatagtggttaagcacattgtcagctccggactctgcctcttacaaggaaggagggggctttagatgttatttagctgttatttagcctttctacacctaagttcccctcacctgtaaaaaaaaaa

SEQ ID NO: 363416 - DNA, 2863 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataaca

SEQ ID NO: 363417 - DNA, 2992 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagaaggtcagaattcccagagtcctcaatgtttcaaaacatgctcagagcaaaatggttatgttctcacattgtcaaatgcacaaccagttctgcaatatggtaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataaca

SEQ ID NO: 363418 - DNA, 1763 bp, Homo sapiens
cagtgttagtttatagtgaaatactctgcaaagtttcaaacatgtttatttgaaagtctaattaaatgatagcagagagaaaatttcctgaagtgtaatcttcttttatactgtcagtatgtgcttgattgaattaaggaatttatatttggttttacttttcttaaaagttccaaaattatttttcccctaggaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363419 - DNA, 911 bp, Homo sapiens
cagtgttagtttatagtgaaatactctgcaaagtttcaaacatgtttatttgaaagtctaattaaatgatagcagagagaaaatttcctgaagtgtaatcttcttttatactgtcagtatgtgcttgattgaattaaggaatttatatttggttttacttttcttaaaagttccaaaattatttttcccctaggaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataaca

SEQ ID NO: 363420 - DNA, 106 bp, Homo sapiens
cttaaacctaagagaagaaaaaatttaactttgagtaggaaggaagaatctagttttgataatttgcgaaaggaggaaggacatatcccagattcttgtcaagaac

SEQ ID NO: 363421 - DNA, 2802 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaagtcgaagcattgcagacggataatcatctatatttcgtctagtgcaatacagtgtacgaactcagtgtgctacgattatatcgcaggagattcca

SEQ ID NO: 363422 - DNA, 3599 bp, Homo sapiens
ggagacgcagacagggatacggtactgtccatggacctctgagctgccctttccacatcgctgattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363423 - DNA, 3792 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagaaggtcagaattcccagagtcctcaatgtttcaaaacatgctcagagctaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363424 - DNA, 3460 bp, Homo sapiens
gatggagtactgctccatccaaccttgaatataccaacccaatcttttggatgtggatgaatattatggagttaaggtgtaatgacattccaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363425 - DNA, 3527 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363426 - DNA, 3796 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagaggctctataaatgggttacacaattgtctacagcaagcatttagaagcagagaaatgtttctggagtaaagacttttaagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363427 - DNA, 2396 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaaggtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataaca

SEQ ID NO: 363428 - DNA, 2288 bp, Homo sapiens
atgatgtgtataactttagtctttgttggcttttaaaacaagagcagctttgtggacttcttaggatttcctaaagtaatatgtaaaaatattatttacttagttactgcaaggaggaaatataactaattcattgactcatttaacaacttattaacattttgaataggctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363429 - DNA, 2417 bp, Homo sapiens
atgatgtgtataactttagtctttgttggcttttaaaacaagagcagctttgtggacttcttaggatttcctaaagtaatatgtaaaaatattatttacttagttactgcaaggaggaaatataactaattcattgactcatttaacaacttattaacattttgaataggctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagaaggtcagaattcccagagtcctcaatgtttcaaaacatgctcagagcaaaatggttatgttctcacattgtcaaatgcacaaccagttctgcaatatggtaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363430 - DNA, 1877 bp, Homo sapiens
  misc_feature (4)..(4): n is a, c, g, or t
  misc_feature (30)..(30): n is a, c, g, or t
  misc_feature (120)..(120): n is a, c, g, or t
  misc_feature (148)..(148): n is a, c, g, or t
  misc_feature (154)..(154): n is a, c, g, or t
aagnatatgtacactctcagtaaaacaatncataatagtatgacctgcaaaatggagtaatgaaagacaagtaaaatgctgaaatgtaaacgacctagctaagtcaggccattataaagncttaaaggagtctagaaatccacagaanggaaantggaatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363431 - DNA, 2037 bp, Homo sapiens
gttgtttggggatgggaactagttttgcaaaaaacacctaatgttgtataataatgcaccaatgatcttgctggttaaaaatacagtatttttggccaaaaacaaaaacatgtcctccgactgattctgatgcatacaagcatttgagaaccagtgccataaaaactttgctattaaaccaaatgcactggtgggaagttatgagttgtatttatccttacagtcttacaaaaggcattttctgttaaacgtggaagaattcttggtactaatttcacgtaattgtgattggatttgggaggttttaagggggaaaaacggttttgttaatctaattgtaaaattgaatttagaggctctataaatgggttacacaattgtctacagcaagcatttagaagcagagaaatgtttctggagtaaagacttttaaggtaggttgtttagtatgaatatcagctaactagataaatggaaccttgtcatatatggacaagttgttgttctacatttattagaaacatgtaattctttcatttttctctttaagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363432 - DNA, 718 bp, Homo sapiens
agtgggttttgccctagtgaagatacaaggggaaaggatattctgggaatataagcttaaacctaagagaagaaaaaatttaactttgagtaggaaggaagaatctagttttgataatttgcgaaaggaggaaggacatatcccagattcttgtcaagaacagtgtggggaatgagacatggcaagtattgttaaattgaaataacatgaattttataataggaagtttaataattttgtttgttaacttcctcttaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgaggttggtgttcacagtgagatagtgattcattgataattttaagaacagagctcatgttggttggcattttaagaattttaaggttatgtgagagttgccacaaaaatcgaatgctttggctgggcgcagtggctcacgcctgtaatcccggcactctgggaggccgaggcaggcagatcacgatgtcaggatatcgagaccatcctggctaacacggtgtaactctgtctctactaagaatacaaaaaattagacgggcgtggtggcaggca

SEQ ID NO: 363433 - DNA, 3715 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363434 - DNA, 3674 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaagggaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363435 - DNA, 3815 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagaaggtcagaattcccagagtcctcaatgtttcaaaacatgctcagagcaaaatggttatgttctcacattgtcaaatgcacaaccagttctgcaatatggatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363436 - DNA, 3520 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363437 - DNA, 3912 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagaggctctataaatgggttacacaattgtctacagcaagcatttagaagcagagaaatgtttctggagtaaagacttttaaggtaggttgtttagtatgaatatcagctaactagataaatggaaccttgtcatatatggacaagttgttgttctacatttattagaaacatgtaattctttcatttttctctttaagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363438 - DNA, 3064 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagaggctctataaatgggttacacaattgtctacagcaagcatttagaagcagagaaatgtttctggagtaaagacttttaagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggaactgggcaggcaaaaggcttctcttcccctccattcatgcacatggagctgaggatggcttcggagctgatggcactctctgtggtccaggactcatcgctgtccgactcctcatagtccacctcctcctcgtcatactcgctgcctgcaggacaagagaagtgcaaggactgtcaggagcgctcatctccccacaggttcacccggccacttccaggacaggagatgtggccgtggcagagcagcgctgacggcccagggagagggcactcccggcaccaggggactgcaaacacggctattcccttacaaccctggaagcaggagccctgcgttcccacctaagagaccagggcaagggcttcccaacaattcacagctaggagttggcggagcaagaacattaactcggttctatggcaacccagcctgtggctgcaaaggcacagggaagacttgctctggggccaaaaccaaaaataagcaacgatgacaggctcctcacactccccatgctagtgcctgacactcccaaatgagcagaacactgtccccttagttttatgctttactggcctagtaaatgcagaagtctcc

SEQ ID NO: 363439 - DNA, 2047 bp, Homo sapiens
  misc_feature (20)..(20): n is a, c, g, or t
  misc_feature (24)..(24): n is a, c, g, or t
  misc_feature (29)..(29): n is a, c, g, or t
aagcaggctggtaccgcccnggangtaanggataagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgtaatttcattgttgtcaaatttatttgtgaaagtttttcattaatctagcatcttgaacatctttttttggtttgggcctttaaaatacttctgaattgtattccctttcccttttataatgtgcgtgtgaataatttaaagcaccaacttttgattttgccgcttttgtagttatcatcaaaatagtttacatttgttctgagcaaactagctattgaagatgttaacctaatatttagacttggtggcattttgagttgctatatgtgaactgcagcatatcatgtcgtcacttgtatttgtttgtggaagcagagtttgtatattgttagaatcctttaaaaagtt

SEQ ID NO: 363440 - DNA, 1411 bp, Homo sapiens
aggcggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaaggaaccagagaatcatcaaggaaggactacaatataaagtgtcatccaacaggactggaaattcatagcatttccctcagattctaaaagtataatggatacataatgtaaccaaaaaaaccctctaagttataagacatatgtggtgacaattgtttatttctggggataaaacgtgttggccaggagagatagttcctctttgttactagtcaatggacttttagtttttttttttttatgaatttgcttcatattccaaaattagtctccattttaatcaagcatgcctgctgggcagctacaactccagactttcaaactggtctggttggatggcttataaaatctgtgacatttcttggcacttgttttaaatctgttccatggtgtgaatcctatagtagttctagaggtcttctatttgaggtactgagtatataaactgttgaatatctgaaagattgttctgatgtatcatctataatttcatttaaagttttgtaatggattctccatgtaataagcagagaccttcattttcttcataataggagaaatttattgcatttccattcttttataaaataatatgactagcttattacctattc

SEQ ID NO: 363441 - DNA, 1816 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363442 - DNA, 1679 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363443 - DNA, 977 bp, Homo sapiens
ccctgatacgcctcttttcactctcttctctgtggagacagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363444 - DNA, 1676 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363445 - DNA, 1177 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctcctacgacatctcagtccagacctcctgtgccagccgtccccttcttcctcacctcctgaccgctcattccactgaattccctccagttgca

SEQ ID NO: 363446 - DNA, 719 bp, Homo sapiens
gcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtg

SEQ ID NO: 363447 - DNA, 1731 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363448 - DNA, 1136 bp, Homo sapiens
cgagagttttgttagaaccgcgtccccgccccagttccctgtccgtgagccgatttatctgccggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363449 - DNA, 2628 bp, Homo sapiens
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363450 - DNA, 1298 bp, Homo sapiens
cgagagttttgttagaaccgcgtccccgccccagttccctgtccgtgagccgatttatctgccggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctggtgaggggcgtcggtgcgaccgccggaagcccctttcctaactcctggaattccctgtcactcagtcactccgccagccgttcagcaagcattaggcctttcaggcgagggcactgtgccaggcactggggtgccacagagaccctgttaaaagtcccgcagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363451 - DNA, 2033 bp, Homo sapiens
cgagagttttgttagaaccgcgtccccgccccagttccctgtccgtgagccgatttatctgccggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgaaaaaaaaaaaa

SEQ ID NO: 363452 - DNA, 430 bp, Homo sapiens
taagaactgtcctcacaccctcatttggacaaaggagctgttggccacctctactgcgttcctgaaccagatcacatgatacacatgtgttaggtctatggcaggttgactatagtgtgggacactttagtgagacagaagtcttagattacaggatcaataataaaaacacattattccttgggaggctgaggcgggtggatcacttgagcccaggagtttgagaccagtttgggcaacatggtgaaaccctgtctctacaaaaaagagaaaagaaaaaatcaaccaggtgtggtggcacacacctatagtcccagctacctggggggctgaggtggaaggatcgcttgagcccagaagatggaggttgcagtgagccaagattctgccactatgctccagcctgggcaacagagtgagagcctatctg

SEQ ID NO: 363453 - DNA, 3137 bp, Homo sapiens
ggcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttgtaacacgtacacagacctctcggccggaatctccagggatgaccagcccctccccacgcatccagataatctccaccgactctgctgtagcctcacctcagcgcattcagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363454 - DNA, 1874 bp, Homo sapiens
gtttcttcaaaatgaaagctattttactgctttatttataatgctaaatgaacactggaaattagagcagtacaaaaaataagaaaaaatcacctcaaatcccaatacccagagcccaactgttagcgtggtgaacattttcccaatactttatatacacatctatacttgctgttttataatctccttttaaacttttattgagcaatatgtcatggatgtctttcctggtcagtaaatacaggtttgtattatcgttttttaaatgagtctctagcagttcatcatatgaagactcctactttagtctgtcctctgttgatgaatttccaggttttctcttggtggtgggggtgaggagagttggaataaacaagagtgaagggaacacatctgtacatacattttgtactcatttggttttttctcatgataaatttctataagaggaactgttgaaatcagaaaagagaggtgggtggatggtggatccgtttggtttgattctgtgcaatacagacgggaccccaggagcctttgctgagctgtggttgaagggcatcaaacagtctccttttctaatgacactcccttttatagattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363455 - DNA, 1820 bp, Homo sapiens
gtttcttcaaaatgaaagctattttactgctttatttataatgctaaatgaacactggaaattagagcagtacaaaaaataagaaaaaatcacctcaaatcccaatacccagagcccaactgttagcgtggtgaacattttcccaatactttatatacacatctatacttgctgttttataatctccttttaaacttttattgagcaatatgtcatggatgtctttcctggtcagtaaatacaggtttgtattatcgttttttaaatgagtctctagcagttcatcatatgaagactcctactttagtctgtcctctgttgatgaatttccaggttttctcttggtggtgggggtgaggagagttggaataaacaagagtgaagggaacacatctgtacatacattttgtactcatttggttttttctcatgataaatttctataagaggaactgttgaaatcagacgggaccccaggagcctttgctgagctgtggttgaagggcatcaaacagtctccttttctaatgacactcccttttatagattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363456 - DNA, 830 bp, Homo sapiens
gtttcttcaaaatgaaagctattttactgctttatttataatgctaaatgaacactggaaattagagcagtacaaaaaataagaaaaaatcacctcaaatcccaatacccagagcccaactgttagcgtggtgaacattttcccaatactttatatacacatctatacttgctgttttataatctccttttaaacttttattgagcaatatgtcatggatgtctttcctggtcagtaaatacaggtttgtattatcgttttttaaatgagtctctagcagttcatcatatgaagactcctactttagtctgtcctctgttgatgaatttccaggttttctcttggtggtgggggtgaggagagttggaataaacaagagtgaagggaacacatctgtacatacattttgtactcatttggttttttctcatgataaatttctataagaggaactgttgaaatcagaaaagagaggtgggtggatggtggatccgtttggtttgattctgtgcaatacagacgggaccccaggagcctttgctgagctgtggttgaagggcatcaaacagtctccttttcaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363457 - DNA, 2889 bp, Homo sapiens
  misc_feature (57)..(57): n is a, c, g, or t
aggggggggggcgggtgggagggtgaagggaaggtcttttgtaacgacgcgctgaanctccagcgctaaacattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363458 - DNA, 3129 bp, Homo sapiens
ggccgggtggagaggccggcgcctggtcttgggtcagcaggtgggctgcttccctccgcctggaacgcgtctcgaatgagtactgaggaacaatagtaataaaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaaagaactggcattcattccactcacaacattccaccggggaacccgctttggtcaggtcttcggccgggttggaacaaactgccttcagcaggatggggcctgacacatttgggaccctcggtccacgaagtacacccggaaatccccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363459 - DNA, 2394 bp, Homo sapiens
agatatagatagaccccatctctgaaagagagaaagaaaaagagaaagagacaaagagaaaaggaaggaaggaaggaaggaaagagagaaaaggaaggaaaagagagaaagaaaagaaaagaaagaaattgtccatgaagttagataatacatagctcagtgcctaagatgatgtgtagataatacatacaagttttcattgtttgccggatgcagtggctcacgtgtgtaatcccagcactttgagaggccaaggcaggtagatcacctgcagtcaatagtttgagaccagcctggccaacatagtgaaaccccatctctacggtagaatttaattatcttttcccactgtagtttttctaaatcatagctagaattctgttccccctaaaagctgtagattcacaacaattacatgcttcatttttgctcacagggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363460 - DNA, 1609 bp, Homo sapiens
tactgataggtacctgagattttttaaatgaggttaaaacattgttacccactgccctgagtgtactttttctagttgggtaatttggaacctcctccacagagtttctcagtccgggctagataaaatgtgctaccacatttaaagtggtttcatttacatttcatgtactgtttttcataagttagtgttcagggcagtgatcatagtaaaatactagatgtgcatctggggcatttgggaatgacccagtgcagtagccctggttctcactgccttcctgtggctgggccacacttaaggcaactggaagaaacagctttgtcaagacagcccagtttctccggcctcctgaaatcttgagacaggtgagggaatgcaatttaggggtttctgagaataaggatgtattgttttgtgatgtgccaactttgctgactaactgagtagaagttagccagggcaaggctggaagcggccttagctggaccctcatcctccctgcttcagtctcggatccagcacaaagcctgcctcctgccctgcagggttgcagggcatgtttctgcccttcagaatctgtactcatctccgtcttttggtccccgtagcctctcatgaccttggctgcaggacctaagtaactgataccatctcttgggacagtcagtccaggatgctgaggcttttgaaggctgtaggtaatgatggtttggccatacctattaacatttttttattatttaaagaatgttttttaagagaatagttgatcattagaaggattttagttaaaacattcatagacttattcatagacttcatccttttcttgaagaatgatcctggatagcacttcaataaacacttgctgaattcacctgtttgggaaatgctgggacttagtgcctggatgccccacaaccttggagaaatgccaacacacaccacactcagactcctttctatattcctaggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaaggtagggcacagggacttggggctggggtgtgtcttggttcagcctggtggccatggagcagagcccagccccctggttggaggctcatgtcaaagacacctttgttgacccaggctggcaacatagcaaattggatagcctcagtttcccacagcatccataggctgagagaagtttgactgttaaggtatggaacctttgggctgggcatggtggctcacgcctgtaatcctaacactttgttaggccaggcaggaggatcacttgagcccaggagtttgagaccagtctgggcaacataacgagaccttgtctttacaaaaagtacaagaaattagccaggcctggtggcatctgcctgtagtcccagatactcaggaggctgaggcaggaggattgcttgagcccagagtttgaggctgcagtgagctgtgatcattccaggtactccatcctgggtaatagagcaagatcccatctcaatgaatgaat

SEQ ID NO: 363461 - DNA, 1299 bp, Homo sapiens
ggccgggtggagaggccggcgcctggtcttgggtcagcaggtgggctgcttccctccgcctggaacgcgtctcgaatgagtactgaggaacaatagtaataaaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaaagaactggcattcattccactcacaacattccaccggggaacccgctttggtcaggtcttcggccgggttggaacaaactgccttcagcaggatggggcctgacacatttgggaccctcggtccacgaagtacacccggaaatccccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcggtacgagcccatgaggatggagtctcccctcctcgcctggacaccctccctctattgtgagggtggaaaacagcattttggtacctgtgctgtatttaactaaggatgataaaattgttacaatgacc

SEQ ID NO: 363462 - DNA, 532 bp, Homo sapiens
caaggtgagataaggtctcagtgctacagttaatttgtatattctttttaatataatctattgaacttactttaaaaggaacggaaagaggggaaaacaagcaatccaaaatgtatcagagagagagctggagttgaggatgccttgctgattttctgaaaatcaagttaacttttctaggcagaatggccacagtctgcagtcatcctggaaagccctgggggatgcatctgcatttcatcctgtctcaagctgtaaacctgactttatgtatatctcattgcagagagacaggggtgggggttctgcttagtcactaagcggctgagtctacttagagcttttctactattcagacagcttcacaaatgtggaaggacaggtaaatgcagcatgatcatactgtgcataaaatgttggaagctactctgagtttctttatgtcttaaatagacaaacaggtcttcttgatccagggatgcttgtgaacatccagcagcctttgatacgtgaggatggtacagttctcctg

SEQ ID NO: 363463 - DNA, 784 bp, Homo sapiens
cacaacctccacctcctgggttcaagcaattctcctgcctcagcctccgaagtagctggaactacaggtgcatgccaccacacctggctaatttttgtatttttaatagagacagggtttcattatgttgcccaggctggtctcgaactcctgacatcaggtgatctgcctgcctcagcctcccaaagtgctgggattacaggcatgagccacccgcacctggcccctgttccccagatttaatttagaccttaacctatggctcaaaatggaattgccatagaacaaataacagtttagctgaggcaagacttgaggagtatgtttttgtgggggtgggctgggaagatccccttaggcttatggaccacattccaaggcccattagaccctagttcactgagcaagaaaacatggggagtccgtgcaagccccccgactgcatgggacttcagaatcagacagcaactctagatgccactgctattgaagcatgacagggatacatgttgacagacaaagccatcccctgtccttccttcacctcctgtgccatgtgcctcctcttttccagctaacaatgcccagtccaatgccagagtacctcaacgtgcactacatctgtgagtctgcatcccgtctgcttttcctctcaatgcactgggctcggtcaatcccagcctttcaggcacttgggtaagtggcctcttgctgtgcatgtatcctcgggcaggagccttcctctccctaggaatgacctggaagaactctgagggcctgtcta

SEQ ID NO: 363464 - DNA, 479 bp, Homo sapiens
tcttcttacattttcaacatttgaaacagctgttttaagattgtattttcctggggggcatcctgtagcaacatctcattgattgctttgtcatcatccttctgggtccatacctcagaaccatacaagttcatcactccaggccacagtgaaagcaagaggcgtggtcttcaggccacctctgggcatcattctgaacccccttgtgatccagcccacttctcacccacaggtgtaacacgtacacagacctctcggccggaatctccagggatgaccagcccctccccacgcatccagataatctccaccgactctgctgtagcctcacctcagcgcattcaggtacctgcaacctgccaatggcaaccctgcctttccagaagaactctttccaaaaacaaaccttcctaagggtttcactaaagagttgtgccttttgggcatgaaatacagtacaacttcatcaattctttaaa

SEQ ID NO: 363465 - DNA, 3169 bp, Homo sapiens
gaattcgccgctcccacctcggcgtctcgtctctcgcccgctgccccgcgagcccgcggcccccggctcccgccatccgccgacaccgggagcccgggctccccgcgccctgccctccgcgccgggggccgcccgccgcagacacgggacccgcttcgaggccgctttggcgcaaatcctgaggtaacacgtacacagacctctcggccggaatctccagggatgaccagcccctccccacgcatccagataatctccaccgactctgctgtagcctcacctcagcgcattcagggctctgaacctgcctctggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363466 - DNA, 2635 bp, Homo sapiens
tactgataggtacctgagattttttaaatgaggttaaaacattgttacccactgccctgagtgtactttttctagttgggtaatttggaacctcctccacagagtttctcagtccgggctagataaaatgtgctaccacatttaaagtggtttcatttacatttcatgtactgtttttcataagttagtgttcagggcagtgatcatagtaaaatactagatgtgcatctggggcatttgggaatgacccagtgcagtagccctggttctcactgccttcctgtggctgggccacacttaaggcaactggaagaaacagctttgtcaagacagcccagtttctccggcctcctgaaatcttgagacaggtgagggaatgcaatttaggggtttctgagaataaggatgtattgttttgtgatgtgccaactttgctgactaactgagtagaagttagccagggcaaggctggaagcggccttagctggaccctcatcctccctgcttcagtctcggatccagcacaaagcctgcctcctgccctgcagggttgcagggcatgtttctgcccttcagaatctgtactcatctccgtcttttggtccccgtagcctctcatgaccttggctgcaggacctaagtaactgataccatctcttgggacagtcagtccaggatgctgaggcttttgaaggctgtaggtaatgatggtttggccatacctattaacatttttttattatttaaagaatgttttttaagagaatagttgatcattagaaggattttagttaaaacattcatagacttattcatagacttcatccttttcttgaagaatgatcctggatagcacttcaataaacacttgctgaattcacctgtttgggaaatgctgggacttagtgcctggatgccccacaaccttggagaaatgccaacacacaccacactcagactcctttctatattcctaggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccgattggcccggatcctcgttcgcctgccggcactcaggctgatgagctccaacataacagaagaacttttttttactggtctcattggcaatgtttcgatagacagcataatcccctacatcctcaagatggagacagcagagtataatggccagatcaccggagccagtctatagcgcaaaccacacacctgccaaggagcaacagaatccttccaggaccgttcacatacaaagaaaagtagtggtattttggtatgtgcaaatatttccatatgttagccatttcctgtctggtttctccttatctgttaatcccagacaatagcaattaaaagactagtaggatcctttcctgacataagaaatgttttaatgccttttgatgaagcagcagattttggaacaatcttttaactcaatttgtatttagaaattctcaaagggcaaaaaacaaaaaaaaaggttttataatgtcagagactagtattaaagaaaactgaaagaacctgagagaatagtatgtgtgtatatatatatataaaaaagtccttggaattatagatactaattaccagggtaataatattagcactttctaagcacttatcaatgtgtaacgttagcaacatcttgcctgtgggcagggcaaatggaaaactgtgtatgtcttttgccgaaatgctaatgatttctgtgaaaactcactagggtacaggagacaatcatttatgtttaagaaaagaaggcatcattcctaattgtgtgcacatgttgtggagttgagctgaattctgtgaatggaaacgtggctcatttgcatcatgcagtaagtgggagtgtggtagcacagtcggtggtgacccagttcagaagcttctagccatagagcagacacttgtcaggttccctgactacttggtcctggtctctgatgggcatctgcagactcctctagaacctggggttctcctttgatgactggttatctgaattggattgcaactagtcagacattaactgccaaatgagatgtacagttcctccagcaagtgaaaacatccccaagtcacatccgccgctcgtggcagatggagccttgtgaccaaaaagtgcaaggtgggcattttgagctcttgacagtacttccaatacaattgggggtgcttgtgtgtttgtccagatggaggagtgtggccttggagtgtgagcgttaccttcccagggctttccactccaaatgcccccttgaaaagggctcgtgtttctgcagctc

SEQ ID NO: 363467 - DNA, 1967 bp, Homo sapiens
  misc_feature (57)..(57): n is a, c, g, or t
aggggggggggcgggtgggagggtgaagggaaggtcttttgtaacgacgcgctgaanctccagcgctaaacattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaagcaattgtgctgcttcaactgagaaaatctatatccggaaagacctgagaagtcccctgatagctactcccacgtttgtggcagacaaagatggagcaagacaaacaggtcttcttgatccagggatgcttgtgaacatccagcagcctttgatacgtgaggatggtacagttctcctggccacggattctaaggctgaaacaagccagggagctctgggcacactggcaaatgtagtgacctcccttgccaacctaagtgaatctttgaacaacggtgacacttcagaaatccagccagaggaccagtctgcaagtgagataactcgggcatttgataccttagctaaagcacttaataccacagacagctcctcttctccaagcttggcagatgggatagacaccagtggaggagggagcatccacgtcatcagcagagaccagtcgacacccatcattgaggttgaaggccccctcctttcagacacacacgtcacatttaagctaacaatgcccagtccaatgccagagtacctcaacgtgcactacatctgtgagtctgcatcccgtctgcttttcctctcaatgcactgggctcggtcaatcccagcctttcaggcacttgggcaggactgcaacaccagccttgtgcgggcctgctggaatgagctcttcaccctcggcctggcccagtgtgcccaggtcatgagtctctccaccatcctggctgccattgtcaaccacctgcagaacagcatccaggaagataaactttctggtgaccggataaagcaagtcatggagcacatctggaagctgcaggagttctgtaacagcatggcgaagctggatatagatggctatgagtatgcataccttaaagctatagttctctttagccccgatcatccaggtttgaccagcacaagccagattgaaaaattccaagaaaaggcacagatggagttgcaggactatgttcagaaaacctactcagaagacacctaccggtcaaaccaaacaactcactcattcttccccaagatttttctgatgtgctccatgatctccttattgctcttggtctccacatccaccaggacctgctccccagaatctggaaacggaaagcacggggcagaagagaaacagaactcacagcgcactcagcctcaaaaagttgtaatttgggacttgcttttagtggcagaaacattttaataataaaatagatatacttgtttacataatctgtaatactacccttcctttttccatttttctttagacctgagcaagcataaactttagatatgtaaaaaaacatgccattttaatagaaagacattccatgttcatgga

SEQ ID NO: 363468 - DNA, 586 bp, Homo sapiens
gggagccaccgcatctggctgctttgacatatttttagaccatgggatttcagatcatttttagtgatgccaggatactttctgtttaaaatccatacgtgctactattttcattgaatgtgggagtgtgagaactctcaaataacctaaaagtatatgggtgatagaaagaaggtatattttacagagataagagaaactcgaatgtccttcttagtaagtgtcagaagtgacttttattaatttttacttaaaaatttaaaaaataggacatgctctttagtttaaaaaattgaaataagtaggctgggcgcagtggctcacacctgtaatcccagcatttgggaggccgaggcaggtggattacctgagatcagaagttcaagactaccctgaccaacatgttgaaatcctgtctctactaaaagtataaaaattagccaggcagaggagtgggcacctgtaatcccagctacttgggaggctgaggcaggagaatcgcttgaactcgggaggtggaggttgcagtgagctgagattgcgccactgcactccagcctgggtgacagagcaagactctgtgtcc

SEQ ID NO: 363469 - DNA, 2246 bp, Homo sapiens
gcagaacataaacaatggccagctgccggctgcacgcctataatctcagcactttgagaggccgaggtggggtcagttgagtccaggagttcgagaccagcctgggcaacatggcaaaacctcatctctacaaaaaattagccgggcatggtagcacgcacctgtgatcccagctacttgagagctgaggtgggaggatagcttgagccaggagcagaggttgtagtgagcgagatcacaccattgcactccagcctgcacagagcctgactctgtctcaaataaataaataaataaataaaataaaaatcatgacttctccattgacagcctttatttctattttcttatgtgctttatctacagtatttatcagcatctattacactcttttttaaatttgattttgttgtgtccctcactagaatgtaaactgtgtcatattcttggtgtctttctctatcttcattttcagctattaagactactccttaaatagctgtagtcagattttcataaaaaggttagactataaatacggtgtcagggccttgtgaacccccattgcagcctacatcagtgaccctcaaggagctatcttcagcccaccaacgtcctctcaaattctacggaaatttttggaccactgaattttccatagaaactgtatatactattaagggttagtgcaaatacctgactaatgtggtattcataatctaaattaagacacaatggtcatttgtagattaacttgaagttctacaagagacatggctgttaagaaatagtgcattattttgccaacctcctatgttgtatatgtgcataaagtgatttaaaaatcctttgttttcagaaaggatgctggatgatgagtgatgttataagcttttcagaatggtcaactattactatcttgcttatattatctttctgttaatttaccttttattattgcaattttcttttctctggattgttcatttggttgattcattatctaataacagaatgttgaagttttcatgcactgtggtccaaatgcttcctgctttcctgaatagatagagttgatcgatttattattggtaggaattgtgtttggcaattcatctactctttttaaggttttgtttgttaatacatctgaaaagatgatatacaagattgagacatgagaagcattggttcaacactaatgcatctacaagaattaggtttgggaaggtgggaaagattacctcaacatttttaaaaattggaaactgcaaccaaaataagctgaaaaaatccctattaacacttaagaagagtctgcattaagagtctttccatgatttttattaaactagagagcctcacctggctgctctagggttcctcatatgcaaaacagaaataaggggattcccctgactggtccccatgttgttaagtgttctccccacccccaccctacccccagcttcttaatgaagcaggcctccatcctcctaacttgagaggatgtgaatcattccacagatgtctgtcttctagcaccacccctcgtatttcctctacataacaggtcttcagctgcattctaggaacaccatatactactgagctgcaaatctatgctaagcatataagacaatgactgaaagggaaaaaaatttttttaattacaaactcaattcatttggtgcatttcaaaggtgcaatacttttcttcatttatcagtgaaagaagttagaaattaacttcccaaaaaaatcagcaaatggcaaacaaatgtccttgaaagtcacagtcacatatagtgcgtcctagaaaagaggaggggcaagatgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaagtggaatgtggaatcaatccgtcctcctccccttaagggctaaccactggttaatgaattaaaaaaacaagactaaaaaacaaaccccacacacactcccccccaaaaaaagaggagggaaaaaaacaaaacaaaacactaagatgtcccagattactctccagagtggaaccagggagcagcttcaacaattccaattagtctgttacagagtcatccacaagcatgccttgcttttaaacaac

SEQ ID NO: 363470 - DNA, 956 bp, Homo sapiens
  misc_feature (296)..(296): n is a, c, g, or t
  misc_feature (305)..(305): n is a, c, g, or t
  misc_feature (307)..(307): n is a, c, g, or t
  misc_feature (318)..(318): n is a, c, g, or t
  misc_feature (325)..(325): n is a, c, g, or t
ttatggtgcttttttttcttgtccttacttctggtttctgtgcttgtcttgttgtttttctcgttcgtcgtcgagtgttgttgccgtcgtggtgattcctcctttttcctcgcggcggctattaactctcctgtgaccccggtgggaaaccctggcccccaacacctcggtgggtgttccaacacaccacgttgccccgcgcattttttttggggggagaaaccaccccctgtgtgagcccgatccctctgaccaccagcccccagtcccaaaaccaaggggcccccccccccacnaatggtttnanacttttccggnccacccncccacaatttttttttttttttttttttttttgaaagggaaaaaaatttttttaattacaaactcaattcatttggtgcatttcaaaggtgcaatacttttcttcatttatcagtgaaagaagttagaaattaacttcccaaaaaaatcagcaaatggcaaacaaatgtccttgaaagtcacagtcacatatagtgcgtcctagaaaagaggaggggcaagatgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaagtggaatgtggaatcaatccgtcctcctccccttaagggctaaccactggttaatgaattaaaaaaacaagactaaaaaacaaaccccacacacactcccccccaaaaaaagaggagggaaaaaaacaaaacaaaacactaagatgtcccagattactctccagagtggaaccagggagcagcttcaacaattccaattagtctgttacagagtcatccacaagcatgccttgcttttaaacaac

SEQ ID NO: 363471 - DNA, 1019 bp, Homo sapiens
aggaaggcaccagagattagcccttaaaagccttggttcacccttatgcaccaagattaagtttggaaggttggaaagtttcctcacctaaaaattggaactggcacccaaataagcttaaaaactagagagcctcacctggctgctctagggttcctcatatgcaaaacagaaataaggggattcccctgactggtccccatgttgttaagtgttctccccacccccaccctacccccagcttcttaatgaagcaggcctccatcctcctaacttgagaggatgtgaatcattccacagatgtctgtcttctagcaccacccctcgtatttcctctacataacaggtcttcagctgcattctaggaacaccatatactactgagctgcaaatctatgctaagcatataagacaatgactgaaagggaaaaaaatttttttaattacaaactcaattcatttggtgcatttcaaaggtgcaatacttttcttcatttatcagtgaaagaagttagaaattaacttcccaaaaaaatcagcaaatggcaaacaaatgtccttgaaagtcacagtcacatatagtgcgtcctagaaaagaggaggggcaagatgggctccacccactttcatgagtttcatcaaatactggatctactcaagggtggagagaaaaggcaactttcaaaaaggagtatgttattaaatgaggcatttactatactccttcctaagagcaccagatggggaacatgttttctaaactagatctaggaagtggaatgtggaatcaatccgtcctcctccccttaagggctaaccactggttaatgaattaaaaaaacaagactaaaaaacaaaccccacacacactcccccccaaaaaaagaggagggaaaaaaacaaaacaaaacactaagatgtcccagattactctccagagtggaaccagggagcagcttcaacaattccaattagtctgttacagagtcatccacaagcatgccttgcttttaaacaac

SEQ ID NO: 363472 - DNA, 5420 bp, Homo sapiens
ggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgcgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagccgcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatttgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaaatgtgtgtaca

SEQ ID NO: 363473 - DNA, 5309 bp, Homo sapiens
ggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgcgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacagtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagccgcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatttgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaaatgtgtgtaca

SEQ ID NO: 363474 - DNA, 1352 bp, Homo sapiens
acctttattcatcaaatttgtcacttgtcagttgttttaaagtatgtcgtcacggataaccctagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaacccccactcacagtcaccgtcttacaactcagggccacctgggatcagtcatcagtcagggtgcgtaagccttgaataccaggtagccgcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatttgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaaatgtgtgtaca

SEQ ID NO: 363475 - DNA, 2178 bp, Homo sapiens
ggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgcgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtcacgagatgtaccgagctgattcactgcctgtcac

SEQ ID NO: 363476 - DNA, 2440 bp, Homo sapiens
  misc_feature (567)..(567): n is a, c, g, or t
  misc_feature (807)..(807): n is a, c, g, or t
ggatcacctcctcagccaggtcatccccactccctgttaattctggagcattaagtctttctttcagcttctcctcttcatcctcactgtcccccaactgctgcacccctgccactgcctcacctcaagcccctttcagactgtggaccaagctttttgccatgagcaccactctggtcatcttgcttgcctgcttacatggttccacgcacccgtttccctacagagtttcccaacccacccattctccatgcaccccacacccagggttcatccatggagggtgcactcttgcctttgggatggggcaagttcttcatttggcaaatgcagtccctagaaataaaatgactgtgtcatccttccccttccccattccagacgccaccgatgtcagtgccgagagtcaacccacacctagacctcccctgccaggccacaccccctccatctctgaatgcccagacctgtgcagtaactgcctatgaatcagggccccatttgtgttttaattattttaccctgcagtattccattgcacacctccgcactggcgtatagtggtgngcatagctgcttctggttacacacctcctatggctgaggtgctatggaggatacgtagcaccttatgtcctccacatagcacctgtattctccacagcaccttagccctgggaggtgtgcagcttgaggtgtgtgtttcatctgccagggagtggatggggccaggagagctggtctccagccctaggggtgcccctgatggctgcgtgctgtaggtgagctccttcccctctctgggcnactctcctgttgcgggtctgagcatttgggattccacccagggatcatcagccctgtccctgctggccttccagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttg

SEQ ID NO: 363477 - DNA, 559 bp, Homo sapiens
ggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggagtcatgtaagacgtgcctacttgcccttcaccttcttccaaaattgcaagtttcctgaggcctccccagccatgcttcctgtacagcctgtggaactgttgactgggtttgactccaaatgggaaacttttgggggaagaccaagatggaggcgagtgaatgaagagaaggaaggcgctggggtggagagtctcacagaatagagcagtggttcccaaagtggaacccccaggccagcagcttcagcatcccctggtgtgctcggtgttccttacattaaacattacattaaacattgtgtatatgcacacacatacac

SEQ ID NO: 363478 - DNA, 1995 bp, Homo sapiens
ggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgcgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaaaaa

SEQ ID NO: 363479 - DNA, 372 bp, Homo sapiens
  misc_feature (361)..(361): n is a, c, g, or t
tataaaccaagagctgcttgctggttaggcagaaaccaaatttcctcctagctctgccttgcattttcaatcagaattacttgtttgttacaatatgattttcttcaaaaatagatgctctgaggcaaaaggcgagccacaggctatatgttgaatagaaggttgattagttggccgaacttcaggagtgggagcctgaagccatgcttcctagggaaataactccctctctgatagtttgttttgctaattactagtcccaatttgagctcaatattaccaacaattgctttatagttacttatgagtcaggttcaacattttatgctgattttacttgcacttaaacaaatagaaagtntattttctggg

SEQ ID NO: 363480 - DNA, 467 bp, Homo sapiens
tgttggcatatgttttgtgatctactttttcacttactgtgtggttactacttccccatgtcgttaaatagtcatatataatttttaatggttgcatagactttgttctagccagaagatgtactgtggtttgaccaatcccctcttatagggcatttaggttattttgagtattttctatcaatacagcattggacatctgcatagataaatctgtcgacataattctgattatttccttaggagagagtgctaaaaaaaaaaaaaggacttgctggtcaaacaatgtacatatttttaaaggctattgatagatatagctaaattcctctctaggaattctatattaagataataattatttcaccaggcatggtggctcatgcctgtaatcccagtactttgagaggctgaggtgagaggatcgcttgaggccaggagttcaagatcccatctctacaaaaagt

SEQ ID NO: 363481 - DNA, 567 bp, Homo sapiens
gagatacgttttgtgtgccttgaacagtgatggcccatagatagttgggttttttaatttttaaatgttcatatgttaccagtacctaaccatgagaatatttcctattttaaaacaattctatactaatttctgttttttttgtttttgtttttgtttttttgttttttaatcaaagttcagctgctgagttcaggttcaagttttgtaagaatttgctggatgtgggaacagctgtctcctctagacagaccctagctctccagttggccaccacccctgctgcacttagtggtctcaaacctgggcacttcaccctttcacacaactggccaggctgcaggagacattcgactttgggagccctcctttatgatatgcaaattcccataggcttttcccagttctgcctccaccagtatcacggtggaggcagggcggggcttacggtccccacttcacagatgcaaaaactgaggttcaaagagcataagtgacacgactagtcccaaagccaataagttgatgctaatccttctgtctctaagactaatgtacttttcagag

SEQ ID NO: 363482 - DNA, 444 bp, Homo sapiens
gttgtttttatcgtgagttccacaagtgagcaacatttgcagccttgcctaggagacctaggtagtaccaggagggactgattctacaaagcatgcttggccagaggccttcacagaggcaaagtccctttggagaccacataaggagttccagcagaggccaggcctggctgacccacccctgttcctgggccccggatcctggaccaggccagctcagccctgaggagacaggtctggagaaatgtcctgctctcttccctgatccacctcagccctggagactccgggatcaaaacttatgtcttgtctattacccctcctagaatgtaagctccatgcatgcaaggaattttgtttgtttaatcatctactgtagccccagtgcctagaacaatgctgtcacacaaaagcaaaataaatagttgtcagatgaatgacaaa

SEQ ID NO: 363483 - DNA, 598 bp, Homo sapiens
ggacgtgtgtgagtacggaatcaaaggaagcgctgtatctggtcatttcacgagcaggacacagataccattgcggtccttacacacgtttcatcagcatctccagtagttcatgttcacgtcctccatctccgtttggttgctgttgcacattggagtgtgaactgcaaaaatccccaaaaatcccagatcgacagcatatcttgtgcaggccctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaatta

SEQ ID NO: 363484 - DNA, 796 bp, Homo sapiens
tgcgctctgctggacccccgctccttgctggtactgcagctcctccagcccagccccttgccaagaaaaaagtcgtaaagcggagagcagatactaccacccctacacctacagccatcttggctcctgggtctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggacgcttctgcacttggcctgcatgactaccatgacatcattaagcaccccatggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgtatgtgcttttctttctcttggtcctggagtgaagg

SEQ ID NO: 363485 - DNA, 656 bp, Homo sapiens
agtacctactaacgtttcagctttcaaaacgaacttaccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctaaacaaaccaacagccaaatgttcatttcctctcccatcagaccagtgttgtttaaatttgatcacttgtcttactttgccatgcactcaccaaacctcccaccctttaaaagaagacattatgggctgggtgtggtggctcacgcctgtaatcccagcactttgggaagccaaggcgggcagatcatgaggtcaggagatcgagaccatcctggccaacgtggtgaaaccccatttctactaaaaatacaaaaaaattcgccgggcgtggtggcgggcacctgtagtcccagctactcgggaggctgaggcaggagaatggcatgaacccgggcagcagagcttgtggtgagcggagatcgcgccactacactccagcctgggcgacagagtgagactccgtctcaaa

SEQ ID NO: 363486 - DNA, 855 bp, Homo sapiens
  misc_feature (780)..(780): n is a, c, g, or t
  misc_feature (795)..(795): n is a, c, g, or t
  misc_feature (797)..(797): n is a, c, g, or t
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagncgagctgccattgantngcataccttgaagttgcaccccgaccagggagaagaccgcaagcacggggggtcagca

SEQ ID NO: 363487 - DNA, 2856 bp, Homo sapiens
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaatta

SEQ ID NO: 363488 - DNA, 4069 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363489 - DNA, 2848 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaatta

SEQ ID NO: 363490 - DNA, 4297 bp, Homo sapiens
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagtaagtttttggttttgttttgttttctttgcataagcaaaagacatggttgcacatgttagtatttaaagagaatcataaagatttaatagcaaaggtaagataaagatacaaagcaactgttgttctcttaggagctacactgcttcctcatagtaaatgttctttaatgttgacagcgctaactgcaatgtttaatatgtggcttttgaaatgataggaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363491 - DNA, 4113 bp, Homo sapiens
gacgtatatgagctccggtcctgtttgttatttccatcccgggagtagtgttgtcaagtgttagatgattgggggcgtggctgagatgtaagcacgatgcgcaggtgggtcgatagcatgtgtgcgcctagatccgggggtcctgtgatgcagcagaagagtgaagtgtgacgggtgcttgctacttgtggacgtgcggtcactgtacgtgtccagtctgaacgtttctccgcttccgacgtggcctggatgcacctcagagtatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363492 - DNA, 4164 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgagatgtggtcttgctgtgtttcccaggctggtctcgaacgcctggcctcaagcgattctcccgcctcggccttccaaaatgctgggattatagataatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363493 - DNA, 3935 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagcgatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363494 - DNA, 2905 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaa

SEQ ID NO: 363495 - DNA, 4017 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363496 - DNA, 4007 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttcttcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363497 - DNA, 3185 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaaaaaaaaaaaaaaaaaaaaaaaaaaaaaaaaacaaacaaaaacacacaaaacagcaaacaccagaggggggggggcccataaaaaaattccccggaggggcgcccagattgacgctgacccacgcttcggttgccacaaggggggccccacatgaggaggaccgctcatacaaagccggaagcgagccgggccgcgcttacaacacgccggcgtggggggccaagacgcggccgcgcggaccatcggcgagaagaaacgccacagtcgcgcggggcgcaac

SEQ ID NO: 363498 - DNA, 4068 bp, Homo sapiens
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggttgtcttccacgtacttgttttgacctactaccctataattgtgttttcagatattgttttcattattcttttatttatttatttttttgagatggagtctcgctctgtcgccaggctggagtgcgcggcgcaatctcagctcactgcaacctctgactccctggttcaagcgattcttctgcctcagcctcccgagtagctgggattacaggcatgtgctactacacccagctaatttttgtatttttaatagagacggggtttcaccgtgttggccaggatggtcttgatctcctgacctcgtgatccacccacctcggctctcccaaagtgctgggattacaggcatgagccactgcacccggccagatgttgagatttttaaaactcctggatgattctgatgtgtaggcaaatttgggaactattcctcaaatatttaacttttgaggggctgcttgctcctgagttccaaacacttaaaaacatttacaagatattactatttgttttaagaaagccaaggagttgacttgttttgtttgttgatagccaagaaatatttttcttcatggccctgatcagcaagtaaaaataggagactttggtctggcctgcacagacatcctacagaagaacacagactggaccaacagaaacgggaagagtaagtttttggttttgttttgttttctttgcataagcaaaagacatggttgcacatgttagtatttaaagagaatcataaagatttaatagcaaaggtaagataaagatacaaagcaactgttgttctcttaggagctacactgcttcctcatagtaaatgttctttaatgttgacagcgctaactgcaatgtttaatatgtggcttttgaaatgataggaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363499 - DNA, 2900 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattaattaatcgacactgcctaatatacctggttttttttcggtttgttttttttg

SEQ ID NO: 363500 - DNA, 2850 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaatgagatgaaatgagatgttggaaggagaaatgagatgttggaaggagaaatgagatgttggaaggagaaatgagatgttggaagg

SEQ ID NO: 363501 - DNA, 2797 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagcggcacgaatttcaggcatgctgaggccggatccccttttgggcaggcccgcatggagctcaaggatctgagagggtagacaaagcgacgggagacaggaggtggggtaaaaaacaagggcttcgcgccatagtcgaatatacggggggctgtcatatatttatgta

SEQ ID NO: 363502 - DNA, 2373 bp, Homo sapiens
  misc_feature (22)..(22): n is a, c, g, or t
  misc_feature (24)..(24): n is a, c, g, or t
gcaggtgactctagaggatctntncggagagagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363503 - DNA, 1819 bp, Homo sapiens
ggacgtgtgtgagtacggaatcaaaggaagcgctgtatctggtcatttcacgagcaggacacagataccattgcggtccttacacacgtttcatcagcatctccagtagttcatgttcacgtcctccatctccgtttggttgctgttgcacattggagtgtgaactgcaaaaatccccaaaaatcccagatcgacagcatatcttgtgcaggccctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363504 - DNA, 1716 bp, Homo sapiens
gatcgaggtgtaatttcattcttctgcatatgggtattcagttttcccagtaccatttattgaagaaactgtcttttcttcagtgtatgttcttggcacctttgtcgaaaatgagttcactgtaggtgtgtggatttctttctgagttctctattctgttccattcatctatgtgtctgttttgatgctggtagcttgctgttttggttacgatggctctgtagcataatttgaagtcaggttatgtgattcctccagttttcttctttttgcttaggtcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363505 - DNA, 1343 bp, Homo sapiens
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggtagattactttcccagaccctcctaatttggccagtattggtgactgtgcaggtgtgtggccttctctcgccctctctcagctctggcgcttctgccctgcgttcagt

SEQ ID NO: 363506 - DNA, 1704 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtcttatgtacatggccacatgtcgcaaacaacaacatcttcaccgactggtacgaaggtgtgttacatacactaacatgacaaattgggccaccgagaatctgacgccactgaaatatccactcccaggcccctgcccagcaagtacaaaataggcgactacggctcgggcctgaacagaaatccctacagaagcacccgaacggaccagcagacaccggggcagacaaccaccacaactagctccgaggggacacatgcagacgccaaaccgcaaagagcaagcacggaaaagaaccaccaaaaagaacaagctgtgccgcaaacccacacgtcgacgaaacgcaccaagtccacgtcaacgga

SEQ ID NO: 363507 - DNA, 1461 bp, Homo sapiens
accccccgcggggatacgctctggacctggaaccggtgcccggacccttggatggtccgaacccgggtcccccggtttttatttgggggaaccaaccacggtcatggccgtgtcccttggaccccgtatgcccagttccccttaccatatgggcccccgcccccaaacggaggggtttgaaaccttttttaagggccagccgcccccaaaatttttttttttttttttttttttttttggcatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363508 - DNA, 1495 bp, Homo sapiens
ctcactcctcccctcccccctccctccctccccctcccccccctcccccccccccccccccccccaccccccccccccccccccccccccccccccccctcctcccccccccccccccccccccccccccccccccccccccccctccccccctcccaccccccccccccacccccacccccaacctgactgtaataaggctacgatgccctgcgtttaatattcagtcacgcaggggcaggcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttctctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatgttcttacaataaacttgagaaaatgttaagaaaataaa

SEQ ID NO: 363509 - DNA, 984 bp, Homo sapiens
  misc_feature (960)..(960): n is a, c, g, or t
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagcagtgtgtcctgcccagagctcttggaccagcattatactgtggacatgacagaaactgagcactctatccagcacccagtcaccaagactgccacgcggcgcatcgtccatgcaggcctacagcccaatcctggtgaccccagtgctgggcaccactccttggccctgtgccctgaattggcaccttacgcaaccatcctggcctccatcgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccgccttggggttgctcagatcaagacagagacagaggaggagggtgaggaagaggaggtggccgcagtggcagaataagccaggctgttgtacagggactacaccatctctcaagccatagtaaggcccttgcctgaggcagagctatccaggggacctgcagaagtggtctcctgtggggagggnctctgactgctgggactgaccaaa

SEQ ID NO: 363510 - DNA, 388 bp, Homo sapiens
gcttcacccgaacagttggaaggatctgagtatgatgccaaggtagtatttgttgctttctgccctttcattcaacttattctgcagtcttaaataacaatacagggttgggtgcagtggctcacgcctgtaatcccagcactttgggaggccgaggtgggtggatcaccggaggtcaggagttcaagaccagcctggtcaacatggtgaaacctggtctctactaaaaatacaaaaattatctgggtgcgatggcacatgcctgtagtcccagctactctggaggctgaggcatgagaatcatttgaatctgggaggcagaggttgcagtgagccgaggttgcaccattgcactccatcctggatgacaagagcaaaactccatctc

SEQ ID NO: 363511 - DNA, 395 bp, Homo sapiens
ttctggttgacaaagtccatcaactgttgggtgctggtttgtgatggtttctttgccagctgaggaagccttcctgcttatttctaggttttagaccattctgcagcattgactttgttgaaaatctagattgttcttaagtgtcagatgttaatgtatttagaatgacattaatatttagatgcccatgtaatgagtaaaaaaattagagaaataaaactatttttttttacttcaaggtccttatgttatggccaatgttgcaacaaaaatttttcaagaattggtagaaggtgtgttttacatacataacatgggaattgtgcaccgagatctgaaggtaagtgggggcgatgaaatcattgaaagcagtgggagctttgtatcagggacga

SEQ ID NO: 363512 - DNA, 4438 bp, Homo sapiens
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttctctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatgttcttacaataaacttgagaaaatgttaagaaaataaa

SEQ ID NO: 363513 - DNA, 2913 bp, Homo sapiens
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaa

SEQ ID NO: 363514 - DNA, 3949 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363515 - DNA, 4430 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttctctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatgttcttacaataaacttgagaaaatgttaagaaaataaa

SEQ ID NO: 363516 - DNA, 3944 bp, Homo sapiens
  misc_feature (28)..(28): n is a, c, g, or t
tgtgagagtctagaggatcccgcccacncggtaggtggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363517 - DNA, 3773 bp, Homo sapiens
gctggaacgctggagccccgttgatgaaccaaaacccaatatcgcttcaccaacaaggtgtctacagtctagctatcgcgcaagagcgtactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363518 - DNA, 4034 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcaggttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363519 - DNA, 3874 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattaaaaaaaaaaaaaagactcgagactagtttttattcatttttaactgccccgcaaccccactccaactccttctccaccacccattctcccaatggtctttagaaatagatttcatctgatattctgcagaaatatcaatgagacttggtatgggactggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaacgatcccatggaccatggggtgagtgtcctccaagaccccctgagctcagccctctgcctggagggctccagacctttctgagccctgcttggaggcgagcattttcactgctaggacaagctcagctgaagtggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaacccaggttgaccttgtgatgtgaattgatctgatcagactgtattaaaaatgttagtacattactctaaaaaaaaaaagctt

SEQ ID NO: 363520 - DNA, 3848 bp, Homo sapiens
ggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggttgtcttccacgtacttgttttgacctactaccctataattgtgttttcagatattgttttcattattcttttatttatttatttttttgagatggagtctcgctctgtcgccaggctggagtgcgcggcgcaatctcagctcactgcaacctctgactccctggttcaagcgattcttctgcctcagcctcccgagtagctgggattacaggcatgtgctactacacccagctaatttttgtatttttaatagagacggggtttcaccgtgttggccaggatggtcttgatctcctgacctcgtgatccacccacctcggctctcccaaagtgctgggattacaggcatgagccactgcacccggccagatgttgagatttttaaaactcctggatgattctgatgtgtaggcaaatttgggaactattcctcaaatatttaacttttgaggggctgcttgctcctgagttccaaacacttaaaaacatttacaagatattactatttgttttaagaaagccaaggagttgacttgttttgtttgttgatagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363521 - DNA, 3471 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcaggttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363522 - DNA, 2888 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattaaaaaaaaaaagtcgacgcggccgcgaatttagtagtagta

SEQ ID NO: 363523 - DNA, 2957 bp, Homo sapiens
tgcgctctgctggacccccgctccttgctggtactgcagctcctccagcccagccccttgccaagaaaaaagtcgtaaagcggagagcagatactaccacccctacacctacagccatcttggctcctgggtctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggacgcttctgcacttggcctgcatgactaccatgacatcattaagcaccccatggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363524 - DNA, 2538 bp, Homo sapiens
ggaaggatctgagtatgatgccaactgttcgggtgaagcgtacagacaagtacccactctggacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttctaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcacattcttccaaattaaagtgaatcccagctgatagtcttggcggggctgttttttattctgttctccaaagcacttgagaaggttttcaggcacgctcttgaccgaggagtgcgtgtgcaccgtggacaggaccctgaagtgctcacagagcagcctgtgcagcacaagcagggagaggggaggggaggccgggtttgcgttgatcacgatgtctttcagcgccccgtaatccttcccaagcactgaattcaagtccagcgcattggtggttaaagtcgtgggctcatccgcttggattatgttggttacatccaagtctgcatctggtgtttgaatcatcttggagaggccatcaactgcagctttcaactcatacagacgttttaaaatatcatcttggcgggactcaagagcttgcagagacaggttagactcttcctgtacgtggccagcgcccggcgctgggccgtagctcctgccgtgcacgttggggagccggtacatgcaggtgggaagctccacacggagaggcgcgccgcccccgtgatagggctttacctggtacatcggcatggcagaaccaaagcaaaagggggtagcgcgtgccaaaggccaacgctcagaaaccgtcagaggtcacgacggagaccggccacctcccttctgaccctgctgcgggcgttcgggaaaacgca

SEQ ID NO: 363525 - DNA, 2786 bp, Homo sapiens
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggttcttcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaatta

SEQ ID NO: 363526 - DNA, 3137 bp, Homo sapiens
  misc_feature (2344)..(2344): n is a, c, g, or t
tctctcgctcctcattcccccctccccaatcgctagtagaggctgtttgaatcggcgcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccgttcatgttcatggcccaccatgttgccaacaacacacatttttccaagcacattggtcagcacaggtgtgttctaccatcacagtcaaccatgggcaattgtgcaccgcagcatctgcaagcccaagcaacatcattatgtctatccatggcgccctgcatccagaccaagatacacacacatcaagcgcagcacctataggatcttggccctagccacccagccacccatccctcacagcacagccaccgacacaggcacctaggacaccaacaccagacacacacctgcggcccagcagcacacgacaccaacaacacaatcaacagatacacacagcacgccatggagacgaataccatcatgacatcatggagtcaccggcacctatacacaacgcacgggagacacacaggaggtgatgggaaagcggcaatccactggacagatacttgcacatgccacaacactgatacagcaggacaataccatggattagcaaagaccatattgacgagaaatggattgagaatccaccttggaccaataaggcacggacaactccaataaagacaacgaaacacggagaacgtgggagaacaaccacaggaacaaacatggggcacgacacaggcaaggcagcgaacggaacaacgcgattatcacgattcaaaaaccaacaggcaggatacgactacaagaagaacaaaacatagatgagtaatcaacaagcaatagtcgcacccacggggacaacaagtaccccaaatccccgacagaaagagcaaaacgcgggctggattccacaacagaaaggaagaaaccgaaccccaacaagaataccatagcgttaaccacaacgagacacaaccactaacaaccacggacagggaccacggaggacaacacgtacacaagacacagggccaaagacaagcaaaccgcaacatacatatggaggcacaatcacacagacgcgctggccaggccaccagcaacancggcaccaccacatagcaaacccgacaacgaacaattaccatagaagcaagaactcggaacacacacccgaaccaaacccacggtagcgaaagcacacggccacaagcagcagacacaccacgacagccaaagagaaaaaacaacacaccagatcggcaagcaaacactacaaccagaacacagcaccagaacaaacaccccaacaccacatacatcaacacggaccgacacaggagaactataacaagcaaactggaacagcaaccacagcaacagcgaaggcagatgaccaccaacaacaacaagaacacaataaaaacaccaaacaagaagacactaaacacgcacaaagcgtacacaacacacacacgacgacaccaactacgagagcaccagacaagaagaacaaaagaaccaagacgacggacagcaacggaaagcggatatctacgacaaagggagaaccacacagatgacaggacgagccaccgaaagacagacgggtgacgcgcacgaacggcgcgccgaacaccgcgcgacgcacgaccaagacgccagacacatagagtgacacgaagagcataagcagaaccagacagacaggcgaacacgcgaaacactaaacagtaacaaccaagtagaaagcacggcatcctacagcaggacacaaacacacaggaacgagcaggatcaatagcagagtaaaggaagagcgatggacagcacaccgggagcgacacgacacacgaatagatgatgagacccccccttgacaaagctagacgcagcaga

SEQ ID NO: 363527 - DNA, 851 bp, Homo sapiens
  misc_feature (8)..(8): n is a, c, g, or t
  misc_feature (15)..(15): n is a, c, g, or t
  misc_feature (28)..(28): n is a, c, g, or t
  misc_feature (40)..(40): n is a, c, g, or t
  misc_feature (76)..(76): n is a, c, g, or t
tggtgggnggccctnccagtagatgtgncccaccgatggngaagggaacattgcacgtttcttgttctctctgttnggccagaagcataatgctgtcaacgcaacccttatagatagctgggtagatattgcgatttttcagttaaaagagggaagcagtaaagaaaaagccgctgttttccgctccatgaactcgcttctctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatgttcttacaataaacttgagaaaatgttaagaaaataaa

SEQ ID NO: 363528 - DNA, 442 bp, Homo sapiens
gtggaagttgagaaagtagactagcaagcttcacataagagatcagacttgagctaggtgttgagaaggataaatgtgatttatgagttgaagagggataaaagaatatcctagaagataagagacagaatgaacctaggcacagtggtggatcaaagggtttatgtgaaccttgaagaaatcagcttgatgggagtgaggtacgtaataaatggataggagtgggagcagattaagaaagacctcaagagccaagcagagacttaaaataccctggaaattagaaaacagccattggaaaagttttgacaagttttagcattctgtcgcactcatcttatacatgaggactgatatttctgggtctttctggttactgtgttagatttaggagatttttggttcatggttgactatcacctgcttttggttttcagatttg

SEQ ID NO: 363529 - DNA, 1236 bp, Homo sapiens
tggttttcaaacagatacatgtaaaattaactagtccttatgggacttaagcatcaggacttagtttcctgattcctatgtagttagccttatattataaaccaaaagacaatgaaatactaactacttttttttgccaattaatctctagggtgttttcaaaggaccgtatatcagcttcattccaaatgtgtttcatttcacctgtgactcctttaaactatatttttatctaagtcttaggaaactgtatatttcagtgacaaagatcatcaatatgacttaagaatttttttatgttaccatatttaactgatgattacgtattttgaattaccttgtttttacagcatgtatggaaatatatcaaagaatttataattaaaagtatttaaaacctctcaagttagaagtatagtatataatatagtaattatatggatcacttcatgattgtgcattattgtatatattggacatatttcacttaaaagagaaatgtaatgcatgagaagtagaatccaatgtgttaggaatcttcattcctgaatttttacacggtgctgaataggtactgaaagtaaaaattttagtaactaaatctgccaggtgcaatcacatgtgcttgtagttccaggtattctggattcaaaggcgggaggatcacttggtcccaggagtttgagcctgcagtgcactgtgattgcatctgtgaccagccactgcactccaacctgggcacatagttgagaccttatctctttaaaaaaaagcagggaaggggatgattaaatcttctttgataaattgattttgagaatatttcattgaaaaactagataatttgtggagatacattgtcagttgtatacagactaattaactacattggtgattcactccatggaccattttcttcagatatgtttggaattattatctattcctacacttattgcactaatgactcaccttagaaggaaaagaaaaattttaatttacttaaaaaaaattttttttgattgaatagataattgtgtatatttgtggttaattattattttacactccagacctatttctacacctgtagggaagaaacttaatcactgatatcgtcagcctgtcagataccactgatatcttcagtctagttttaagaaaaactaggactaagaagaagtatataatcaagttcaagctaatcatggccatttttaaattacttggtctttt

SEQ ID NO: 363530 - DNA, 458 bp, Homo sapiens
agcttgctgcgttggtgggacctcagctgtcacaggctacctttctatgacgcctcctcaccttaagtagactctgaacagattttaaaagccattcattcaacacattttttaaatgaataaactttttttctgtgtagttttcagtttacagaaacattggtgggaaagtacagagaattcccagatcccgtccccaccatctcccctgtcattcacacgttgcctccgtgtggtgtggtctgtttgttccgatcgatggaacgactctgatacatgattaactagaggccttggttcacatcattagggctcactctttgtggcgcacatcctgtgggtcttgacaaatgtgtcatgatacgtgtctgacattgctgaagtcaccttttcttaaagcttaacattttgggagtattctgaactatgtttggcccagcctgctgcccgatttttat

SEQ ID NO: 363531 - DNA, 470 bp, Homo sapiens
  misc_feature (23)..(23): n is a, c, g, or t
  misc_feature (29)..(29): n is a, c, g, or t
atgctggagccctgagcctgagntcaagnattcaagcccagcctgagcctccaaaccctctctgcctcctcaccttaagtagactctgaacagattttaaaagccattcattcaacacattttttaaatgaataaactttttttctgtgtagttttcagtttacagaaacattggtgggaaagtacagagaattcccagatcccgtccccaccatctcccctgtcattcacacgttgcctccgtgtggtgtggtctgtttgttccgatcgatggaacgactctgatacatgattaactagaggccttggttcacatcattagggctcactctttgtggcgcacatcctgtgggtcttgacaaatgtgtcatgatacgtgtctgacattgctgaagtcaccttttcttaaagcttaacattttgggagtattctgaactatgtttggcccagcctgctgcccgatttttat

SEQ ID NO: 363532 - DNA, 966 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccat

SEQ ID NO: 363533 - DNA, 490 bp, Homo sapiens
accttagccggctctgacttggaaacaacccttgcgctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccat

SEQ ID NO: 363534 - DNA, 812 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacgggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccat

SEQ ID NO: 363535 - DNA, 2194 bp, Homo sapiens
tgagctcggtccaactcagggcgagctgctactcagggcgagctgcagctcagtgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctgcataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactgcaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 363536 - DNA, 2011 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatccccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatacaaggctttggattttttattagttctgcaataaataataggtttatagttca

SEQ ID NO: 363537 - DNA, 1906 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatacaaggctttggattttttattagttctgcaataaataataggtttatagttca

SEQ ID NO: 363538 - DNA, 1003 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccataaaaaaaaaatttcattatctaatgcggcccaattcc

SEQ ID NO: 363539 - DNA, 2101 bp, Homo sapiens
gatcacgttgacgaaggtggtcttgcccgagtactgaagcccgaccagcgtgagctccatctcctccttccagaatagggccttgaaccagtcagcattaaccacggattgagataagcaccggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctgcataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactgcaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 363540 - DNA, 1870 bp, Homo sapiens
tgacccaccataacctaaccatcatctacaaaaaaatcaaatcagtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctgcataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactgcaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 363541 - DNA, 1864 bp, Homo sapiens
catatcgacgtattatatgaaattaaaaaaaaacttcggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctgcataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactgcaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 363542 - DNA, 2420 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaaatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctgcataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactgcaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 363543 - DNA, 1011 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaa

SEQ ID NO: 363544 - DNA, 822 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctgataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccat

SEQ ID NO: 363545 - DNA, 904 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctgcgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccat

SEQ ID NO: 363546 - DNA, 1272 bp, Homo sapiens
  misc_feature (1043)..(1043): n is a, c, g, or t
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctgataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaggagagagagagagagaaaaaggaagagaaacacacaaaagggggagaaaaagggggagggagaggcaggcagactacgcagagaaaagnaaggaggagcccaacagaggaggcacacccattagaagagaaaaaaggaagggagcaccacactcaacaaaaaagaggtagacagggagaaaacagcagcgagcagcgacagagagaaccacaagggaataaaggcggagacaaaaaggaggggagtggagaaacaaaatggggggagcaaaacaaaacataacagaacggacacggaccgccaaggggcgaagacgac

SEQ ID NO: 363547 - DNA, 1187 bp, Homo sapiens
  misc_feature (958)..(958): n is a, c, g, or t
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacgggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccataaaaaaaaaaaaaaaaaaaaaaaaaaaaaaaaaaaaaaaaaaaaaaaaaaaagagaggagagagagagagagaaaaaggaagagaaacacacaaaagggggagaaaaagggggagggagaggcaggcagactacgcagagaaaagnaaggaggagcccaacagaggaggcacacccattagaagagaaaaaaggaagggagcaccacactcaacaaaaaagaggtagacagggagaaaacagcagcgagcagcgacagagagaaccacaagggaataaaggcggagacaaaaaggaggggagtggagaaacaaaatggggggagcaaaacaaaacataacagaacggacacggaccgccaaggggcgaagacgac

SEQ ID NO: 363548 - DNA, 2468 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctgcataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactgcaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 363549 - DNA, 2522 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctgcataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtattttttttttttttttgagacagtcttgctctgtcatcaggctggagtgcagtggcgcaatttcggctcactgcaacctccacctcctgggttcaagcaattctcctgcctcagcctcccgagtagctgggactgcaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatacaaggctttggattttttattagttctgcaataaataataggtttatagttca

SEQ ID NO: 363550 - DNA, 1957 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatccccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaat

SEQ ID NO: 363551 - DNA, 1000 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccccgaatggcccgctgaatggcgcactgcatgccactcagaatgaccccccagcatg

SEQ ID NO: 363552 - DNA, 1323 bp, Homo sapiens
ctagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaattttatatatacaaaaactaccacctacctcccctcaccaaaaagcccataaaaattaccaaaacaaaacacaaacccacacacagccccaacacaaaacccacgacacacaatcacttccaccgccgccgaccaccaccggtccacacaactgcggccctgcccacaccgccgcctcctccaccaccatcccctgcgccccaacagcgcgcgacaaatcgcaccgcacccccccacatggcggcgcccctgtccatcacacctccatgtatctcggatactatacttaaccgaattccactaatgcgccagtcaccagtcgatttccatccgtcatcgtcgacactaatcataccacccactcactccacacaacacccatatctactccatctctcatttctactgatctcactcaatctcatatctcaactcgttctcctagctattgcttgtctcaaatccaccccaccccccatccacctcctccacaactaactcagccagactatcccc

SEQ ID NO: 363553 - DNA, 377 bp, Homo sapiens
atcaaaaggtggtattttcatttgggtttctcaaatgcacatttcatagctgaggtcagtgggccatagctaaagggggtttctgttgcagaaacctgacccgggcagcacctggcctttgcccagaggctgattgagtgtaggtgagccttgctgtctgtccctcatgggggtcatgtggcctctagctccttttggtacaataatggtattatcgtgatatttaaatgcactctccaggagcgcctgattcctgcaagggcataagcatggtctctaaaatgttattaaaaatataataccaccatatgctcaggctttctcattccgtgatcttctaaaaacaaaaacatgcaacataaacacaccagatgcag

SEQ ID NO: 363554 - DNA, 585 bp, Homo sapiens
tgacctcaagtgatctacccgcctcagcatccctaagtgctgggattacagggatgaaccaccacgcccagcctatattttaaagctttataacatgaactttttaaaaagaataataccttgcatttgtataatttaaaatgaatttttatatgttcattaaaactcatcagtagcatacctttcttggtaacaccttgttaaaaatgttataatatttggggtgttaactgtaataaaactgaatttcttaaaaacagaaacaagaatttagactttttcctgaatggtcccatatttccaagtggcctagattattaaaagtaattgatttggaataatagtaattattatgggtcatatagtatgttaaacactcttctcagattatctcatttaaccatcatcaataactctataagatagaggctatcttttttttttcaacagacaaaaaaacaagtgaggaaggtagattagcaaaagttacagtaaaaaaatataaaataagttgactgtttctgagcaaaaattttgagtttcagattttaaaaaaacctagagcaaaaactcatattagtagag

SEQ ID NO: 363555 - DNA, 1818 bp, Homo sapiens
gccggcggtcgcgccagcgggatccgcctggctcagctgacagctcccgagaacggaagaggcggcgcgccggttgagcagggcgtttctaggcctggtcggctggcggcggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagtta

SEQ ID NO: 363556 - DNA, 716 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcgagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagtggatttgcatgggttctctctctagagcaaacccttacaaacatttcaatgaccctggttcaccatgttttaaccggtatgtatacacagaattcct

SEQ ID NO: 363557 - DNA, 434 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagaatttcaagatatttgtgagcggcaattctgagtgtctccagaatagtggctttgtacacc

SEQ ID NO: 363558 - DNA, 357 bp, Homo sapiens
tgtattggtggtgctggctagagtgctcagtttctgtattggtggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctatatgcaagcaccaccaatacaggcagcaccaccaataca

SEQ ID NO: 363559 - DNA, 3245 bp, Homo sapiens
  misc_feature (3127)..(3127): n is a, c, g, or t
  misc_feature (3132)..(3132): n is a, c, g, or t
  misc_feature (3150)..(3150): n is a, c, g, or t
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaaaaaaaaaaaaaanttggnggccgggccagaaatttnaaaaccttggggggcccagaagaaaaggaagtttcggacacgcgaagggggtcccaaaaaaccgggcgggggaacaaagagggtgtttcagagca

SEQ ID NO: 363560 - DNA, 3181 bp, Homo sapiens
gccggcggtcgcgccagcgggatccgcctggctcagctgacagctcccgagaacggaagaggcggcgcgccggttgagcagggcgtttctaggcctggtcggctggcggcggtgagtgggccccaggcaagggcggagggcggaactttggggttcggcactgccgggcggccggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363561 - DNA, 2843 bp, Homo sapiens
tgcatgggcttcctcacttttttcctcacgaagaggtctctggtctcccctctctgagcactctgaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgcaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363562 - DNA, 3070 bp, Homo sapiens
tgcatgggcttcctcacttttttcctcacgaagaggtctctggtctcccctctctgagcactctgagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363563 - DNA, 3425 bp, Homo sapiens
tggggatagctctctgggcgcgcgaggcagagaaggggaccgggctgggactgtacactgggcctcagtccctcaaatccgggaccgggcgtccgcagctcggctggccgggactcccttcgggacgctgaggaggaaggggaaggtgtgggccctgctccttcgggacgccccaggctggccagcagctcacacatccgcattgcgccctctgatcccagcgttggggcggatagctagcgttgggcctgcccctgttttggggcagtcgcccaaacgacgccgcacgcctagtggcgagctgaacccagactaggacacccgaagaccaaatggatagagtgagaaggaaatgggggttagcaacctgaattgaggtactggattccaagtgacagcttcacaagctgaaatcttgtaggatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363564 - DNA, 3107 bp, Homo sapiens
cgctgaggaggatgaggccggggctccggggacaggccagatgggaagctgctgtccacgcagcaaggcggctgctgagggaaagggagcctctgcatcaccaaatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363565 - DNA, 2940 bp, Homo sapiens
gccggcggtcgcgccagcgggatccgcctggctcagctgacagctcccgagaacggaagaggcggcgcgccggttgagcagggcgtttctaggcctggtcggctggcggcggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363566 - DNA, 2933 bp, Homo sapiens
cgctgaggaggatgaggccggggctccggggacaggccagatgggaagctgctgtccacgcagcaaggcggctgctgagggaaagggagcctctgcatcaccaagtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa

SEQ ID NO: 363567 - DNA, 1774 bp, Homo sapiens
tgcatgggcttcctcacttttttcctcacgaagaggtctctggtctcccctctctgagcactctgaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagtta

SEQ ID NO: 363568 - DNA, 2434 bp, Homo sapiens
gccggcggtcgcgccagcgggatccgcctggctcagctgacagctcccgagaacggaagaggcggcgcgccggttgagcagggcgtttctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctactttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaa
